US011666666B2

(12) United States Patent
Pyle et al.

(10) Patent No.: US 11,666,666 B2
(45) Date of Patent: Jun. 6, 2023

(54) METHODS AND COMPOSITIONS FOR MODIFYING A MUTANT DYSTROPHIN GENE IN A CELL'S GENOME

(71) Applicant: The Regents of the University of California, Oakland, CA (US)

(72) Inventors: April D. Pyle, Los Angeles, CA (US); Courtney S. Young, Los Angeles, CA (US); Melissa J. Spencer, Los Angeles, CA (US)

(73) Assignee: The Regents of the University of California, Oakland, CA (US)

( * ) Notice: Subject to any disclaimer, the term of this patent is extended or adjusted under 35 U.S.C. 154(b) by 888 days.

(21) Appl. No.: 16/076,616

(22) PCT Filed: Feb. 9, 2017

(86) PCT No.: PCT/US2017/017255
§ 371 (c)(1),
(2) Date: Aug. 8, 2018

(87) PCT Pub. No.: WO2017/139505
PCT Pub. Date: Aug. 17, 2017

(65) Prior Publication Data
US 2019/0038776 A1 Feb. 7, 2019

Related U.S. Application Data

(60) Provisional application No. 62/294,090, filed on Feb. 11, 2016.

(51) Int. Cl.
| | | |
|---|---|---|
| A61K 48/00 | (2006.01) | |
| C07K 14/47 | (2006.01) | |
| C12N 15/90 | (2006.01) | |
| C12N 15/113 | (2010.01) | |
| A61P 21/00 | (2006.01) | |
| C12N 5/074 | (2010.01) | |
| C12N 15/861 | (2006.01) | |

(52) U.S. Cl.
CPC ...... *A61K 48/0066* (2013.01); *A61K 48/0091* (2013.01); *A61P 21/00* (2018.01); *C07K 14/4708* (2013.01); *C12N 5/0696* (2013.01); *C12N 15/113* (2013.01); *C12N 15/907* (2013.01); *A01K 2217/075* (2013.01); *A01K 2227/105* (2013.01); *A01K 2267/0306* (2013.01); *C12N 15/861* (2013.01); *C12N 2310/20* (2017.05)

(58) Field of Classification Search
CPC ............ A61K 48/0066; A61K 48/0091; C07K 14/4708; C12N 15/907; C12N 15/113; C12N 5/0696; C12N 15/861; C12N 2310/20; A61P 21/00; A01K 2217/075; A01K 2227/105; A01K 2267/0306
See application file for complete search history.

(56) References Cited

U.S. PATENT DOCUMENTS

| | | | |
|---|---|---|---|
| 2014/0363405 A1 | 12/2014 | Cossu et al. | |
| 2016/0145646 A1* | 5/2016 | Frendewey | ........ C12N 15/8509 435/6.11 |

FOREIGN PATENT DOCUMENTS

| | | | |
|---|---|---|---|
| WO | 2014197748 A2 | 12/2014 | |
| WO | 2015162422 A1 | 10/2015 | |
| WO | WO-2016161380 A1 * | 10/2016 | ........... C12N 15/102 |

OTHER PUBLICATIONS

Modified provisional Application (U.S. Appl. No. 62/141,833) of Huston et al. pp. 1-5. (Year: 2015).*
Zetsche et al. "Cpf1 is a single RNA-guided endonuclease of a class 2 CRISPR-Cas system." Cell. Oct. 22, 2015;163(3):759-71 (Year: 2015).*
Chemello et al. "Correction of muscular dystrophies by CRISPR gene editing." J Clin Invest. Jun. 1, 2020;130(6):2766-2776. (Year: 2020).*
Cox et al. "Therapeutic genome editing: prospects and challenges." Nat Med. Feb. 2015;21(2):121-31. (Year: 2015).*
Park et al. "Extension of the crRNA enhances Cpf1 gene editing in vitro and in vivo." Nat Commun. Aug. 17, 2018;9(1):3313. (Year: 2018).*
Teng et al. "Enhanced mammalian genome editing by new Cas12a orthologs with optimized crRNA scaffolds." Genome Biology vol. 20, Article No. 15 (2019) (Year: 2019).*
Lev et al. "Expression of the Duchenne's muscular dystrophy gene in cultured muscle cells." J Biol Chem. Nov. 25, 1987;262(33):15817-20. (Year: 1987).*
Miyagoe-Suzuki et al. "Skeletal muscle generated from induced pluripotent stem cells—induction and application." World J Stem Cells .Jun. 26, 2017;9(6):89-97. (Year: 2017).*
Danisovic et al. "Induced Pluripotent Stem Cells for Duchenne Muscular Dystrophy Modeling and Therapy." Cells. Dec. 2018; 7(12):253. (Year: 2018).*
Messner et al. "Myogenic progenitor cell transplantation for muscle regeneration following hindlimb ischemia and reperfusion." Stem Cell Res Ther .Feb. 24, 2021;12(1):14 (Year: 2021).*
Braid et al. "Intramuscular administration potentiates extended dwell time of mesenchymal stromal cells compared to other routes." Cytotherapy. Feb. 2018;20(2):232-244. (Year: 2018).*
Tedesco et al. "Repairing skeletal muscle: regenerative potential of skeletal muscle stem cells." J Clin Invest. Jan. 4, 2010; 120(1): 11-19. (Year: 2010).*

(Continued)

*Primary Examiner* — Titilayo Moloye
(74) *Attorney, Agent, or Firm* — Suzannah K. Sundby, Esq.; Canady + Lortz LLP

(57) ABSTRACT

The present disclosure provides a method of modifying a mutant dystrophin gene in the genome of a cell. The present disclosure further provides compositions and kits for modifying a mutant dystrophin gene in the genome of a cell.

1 Claim, 38 Drawing Sheets
Specification includes a Sequence Listing.

(56) References Cited

OTHER PUBLICATIONS

Skuk et al. "The Process of Engraftment of Myogenic Cells in Skeletal Muscles of Primates Understanding Clinical Observations and Setting Directions in Cell Transplantation Research." Cell Transplant. Nov. 2017; 26(11): 1763-1779. (Year: 2017).*
Sokolowska et al. "A Critical Review of Electroporation as a Plasmid Delivery System in Mouse Skeletal Muscle." Int J Mol Sci. Jun. 2019; 20(11): 2776. (Year: 2019).*
Maynard et al. "Genome editing in large animal models." Mol Ther. Nov. 3, 2021;29(11):3140-3152. (Year: 2021).*
Olson et al. "Toward the correction of muscular dystrophy by gene editing." Proc Natl Acad Sci USA. Jun. 1, 2021;118(22): (Year: 2021).*
Luther et al. "Delivery approaches for CRISPR/Cas9 therapeutics in vivo: advances and challenges." Expert Opin Drug Deliv. Sep. 2018;15(9):905-913. (Year: 2018).*
Uddin et al. "CRISPR Gene Therapy: Applications, Limitations, and Implications for the Future." Front. Oncol., Aug. 7, 2020 Sec. Cancer Genetics (Year: 2020).*
Liang et al. "A Decade of Progress in Gene Targeted Therapeutic Strategies in Duchenne Muscular Dystrophy: A Systematic Review." Front Bioeng Biotechnol .Mar. 23, 2022 (Year: 2022).*
Nance et al. "AAV9 Edits Muscle Stem Cells in Normal and Dystrophic Adult Mice." Mol Ther. Sep. 4, 2019;27(9):1568-1585. (Year: 2019).*
Himeda et al. "Book cover Muscle Gene Therapy pp. 3-19Cite as Design and Testing of Regulatory Cassettes for Optimal Activity in Skeletal and Cardiac Muscles." Methods Mol Biol .2011;709:3-19. (Year: 2011).*
Mout et al. "In Vivo Delivery of CRISPR/Cas9 for Therapeutic Gene Editing: Progress and Challenges." Bioconjugate Chem. 2017, 28, 4, 880-884 (Year: 2017).*
International Search Report received in PCT/US2017/017255 dated Jun. 9, 2017.
Written Opinion received in PCT/US2017/017255 dated Jun. 9, 2017.
Shmakov, et al., "Discovery and Functional Characterization of Diverse Class 2 CRISPR-Cas Systems", Nov. 1, 2015, pp. 385-397, vol. 60, No. 3, Publisher: Molecular Cell.
Zietkiewicz, et al., "U94396—Human dystrophin (DMD) gene, exon 44 and partial cds", Jul. 1, 2004, Publisher: Genbank.
Supplementary European Search report received in EP17750785.2 dated Aug. 22, 2019.
Ousterout et al., "Multiplex CRISPR/Cas9-based genome editing for correction of dystrophin mutations that cause Duchenne muscular dystrophy", Feb. 18, 2015, p. 6244, vol. 6, Publisher: Nat Commun.
Young et al., "A Single CRISPR-Cas9 Deletion Strategy that Targets the Majority of DMD Patients Restores Dystrophin Function in hiPSC-Derived Muscle Cells", Apr. 7, 2016, pp. 533-540, vol. 18, No. 4, Publisher: Cell Stem Cell.

* cited by examiner

FIG. 1B
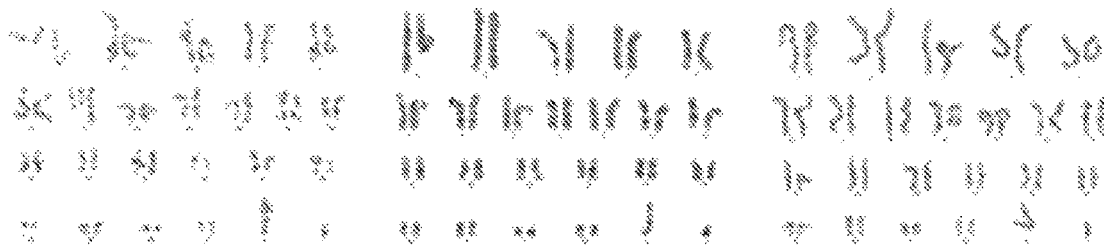
FIG. 1C
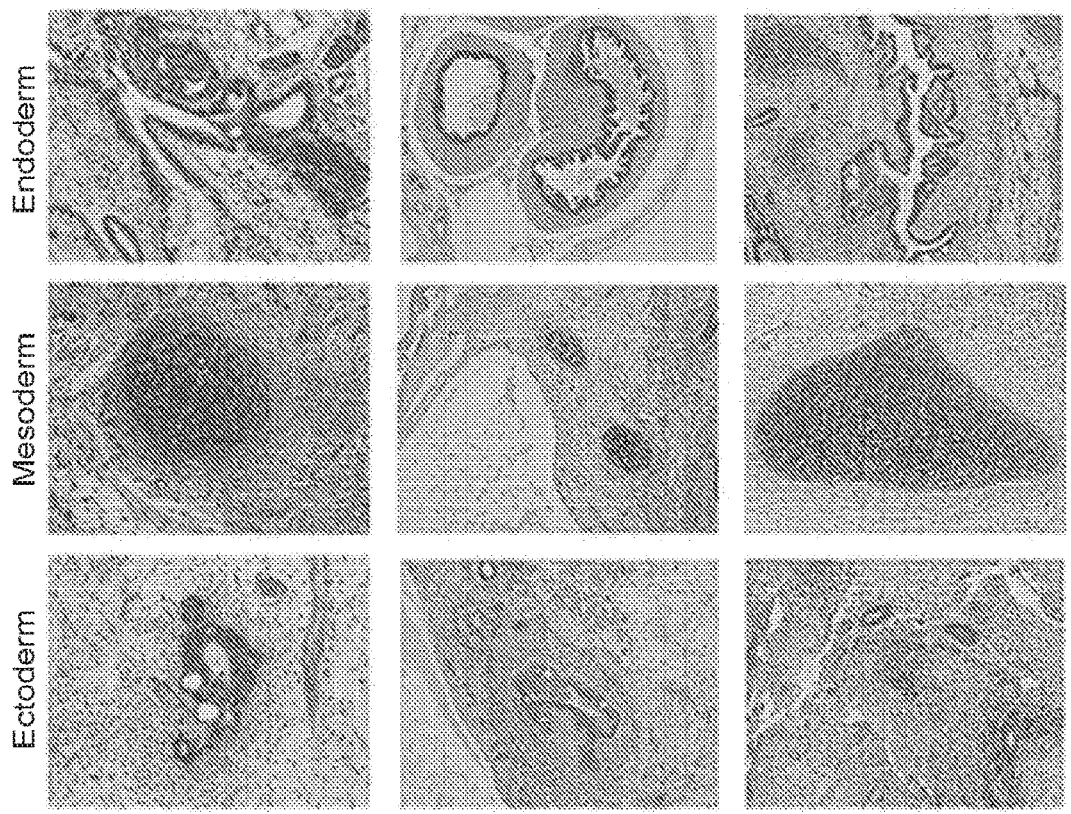
FIG. 1D
| CELL IDENTIFIER | MUTATION | FOR NHEJ | |
|---|---|---|---|
| | | # EXONS | DISTANCE |
| CDMD 1003 | DEL 46-51 | 5 EXONS (45 + 52 - 55) | 530 kb |
| CDMD 1006 | DEL 46-47 | 9 EXONS (45 + 48 - 55) | 670 kb |
| CDMD 1008 | 50 DUP | 12 EXONS (45 - 55) | 725 kb |

FIG. 2B
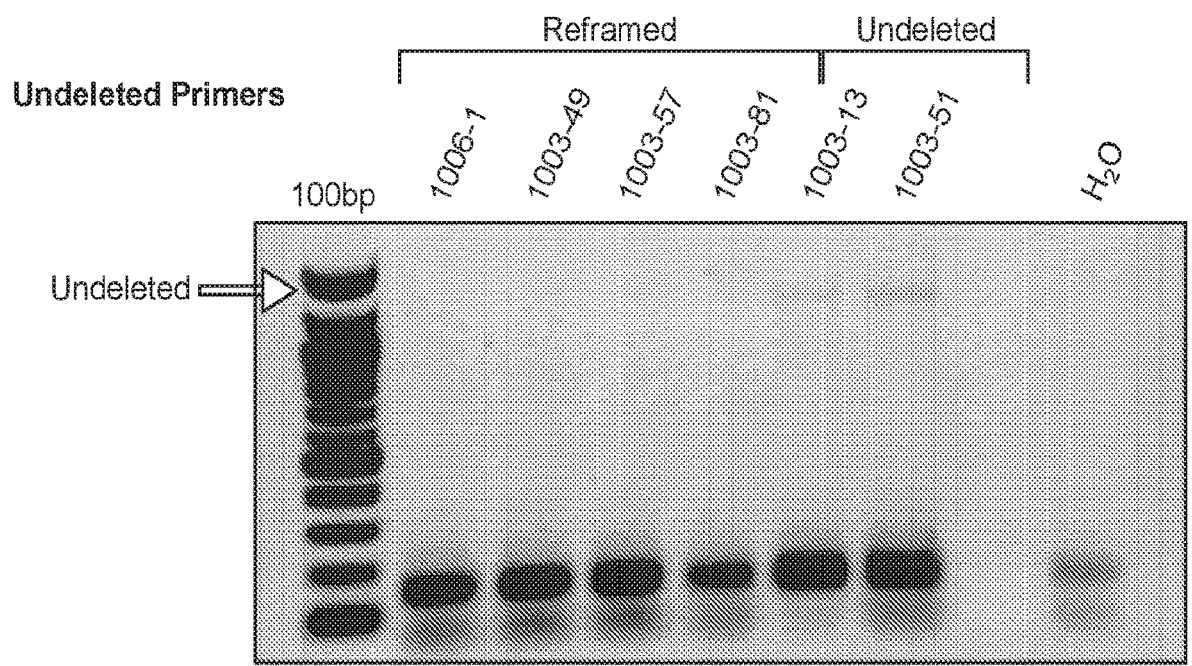
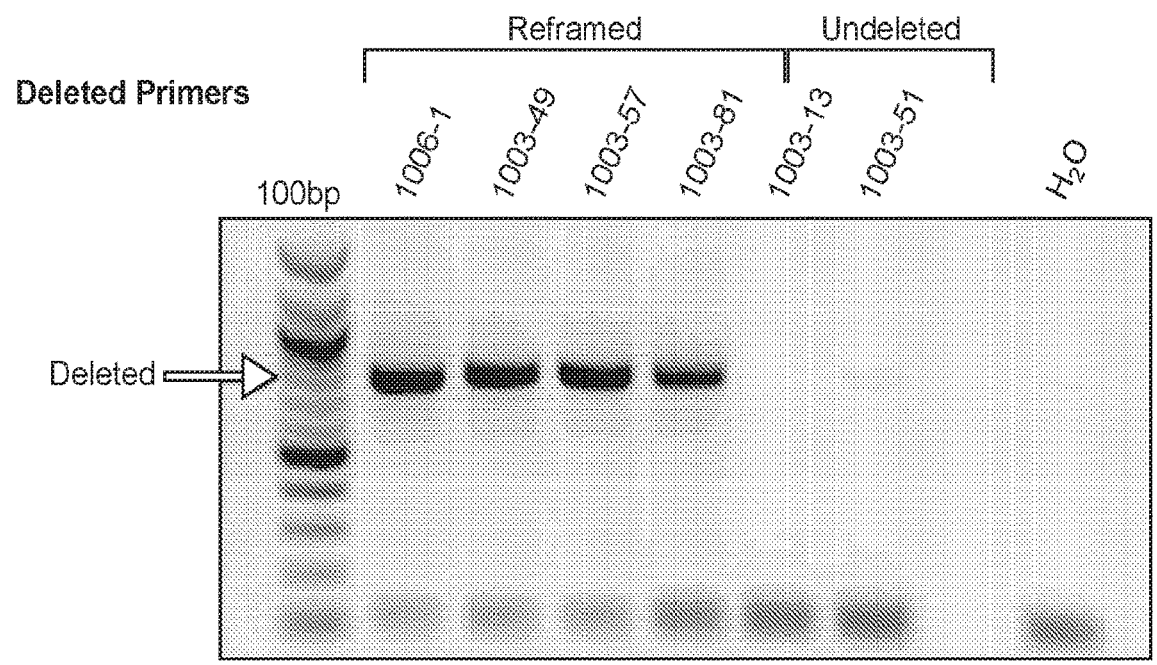

FIG. 2C
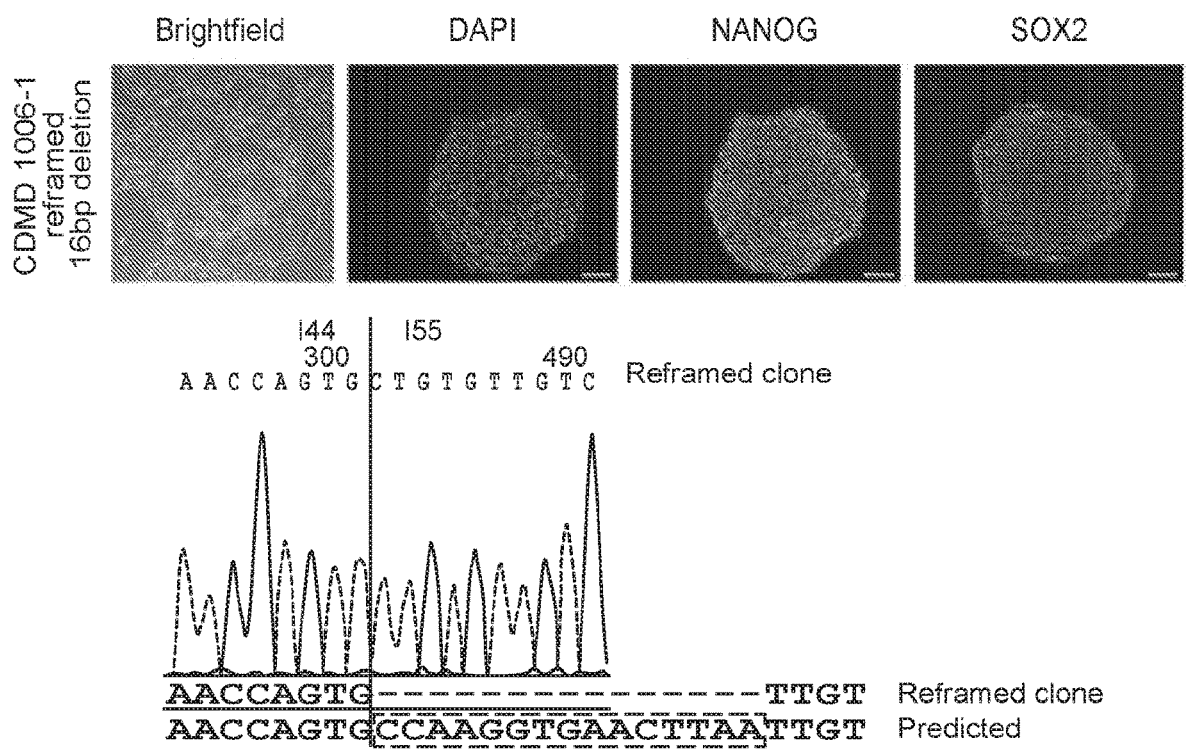
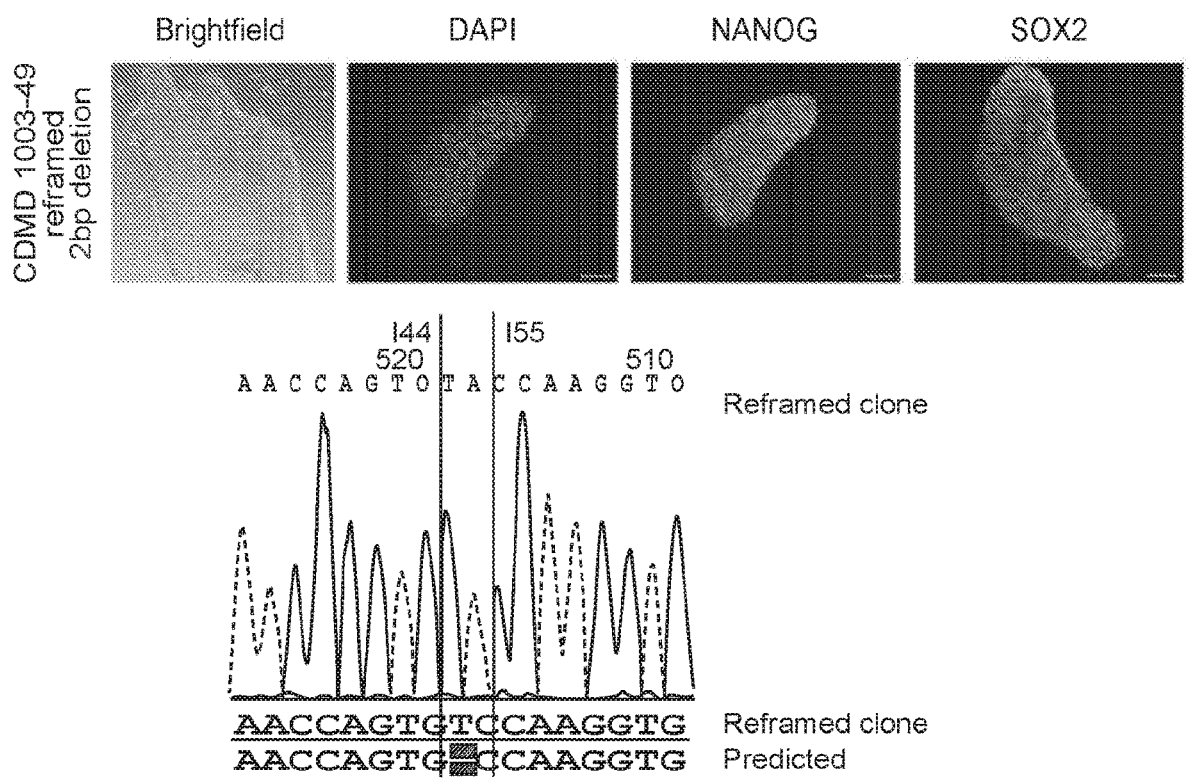

FIG. 2C (Cont.)
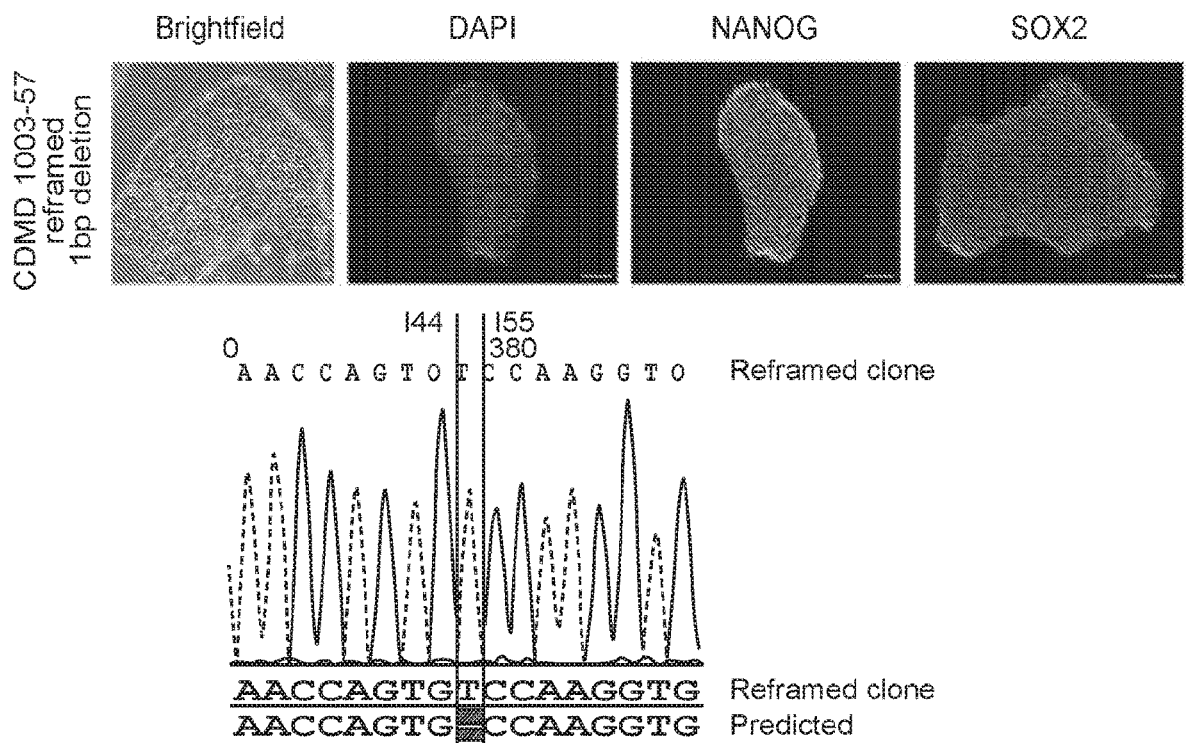
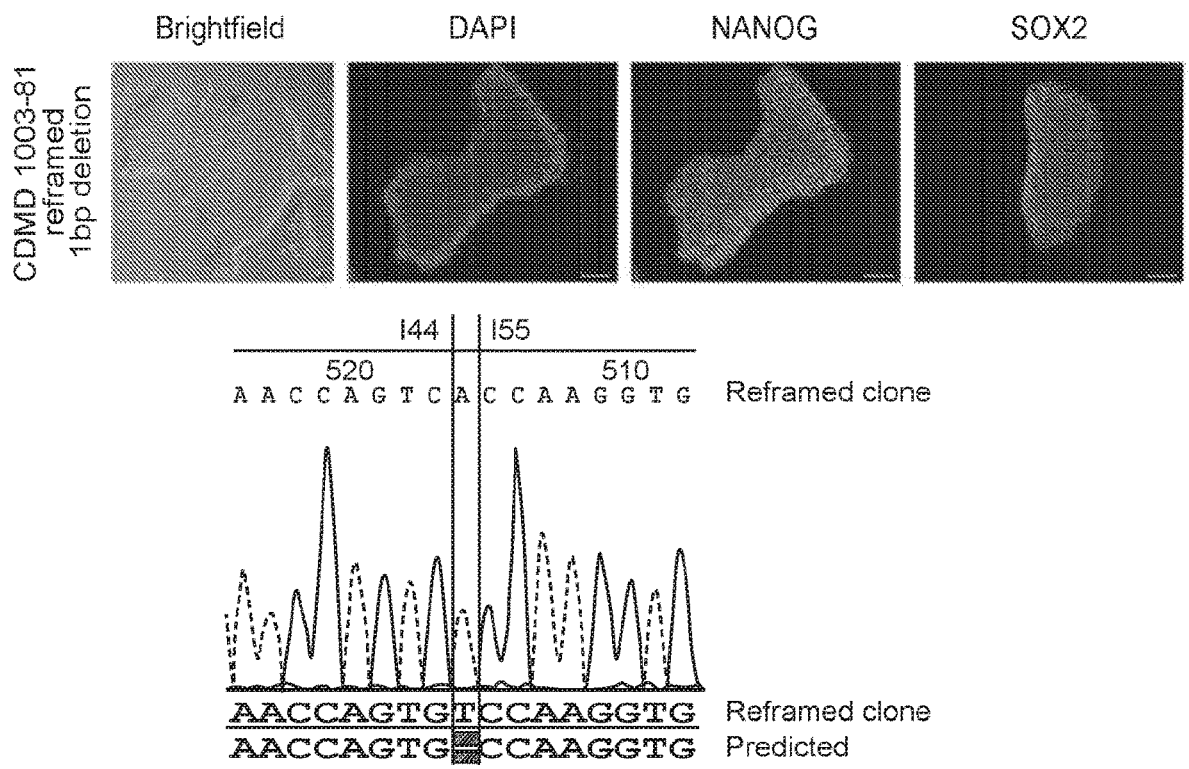

Testing gRNAs to intron 44

Testing gRNAs to intron 55

FIG. 5A
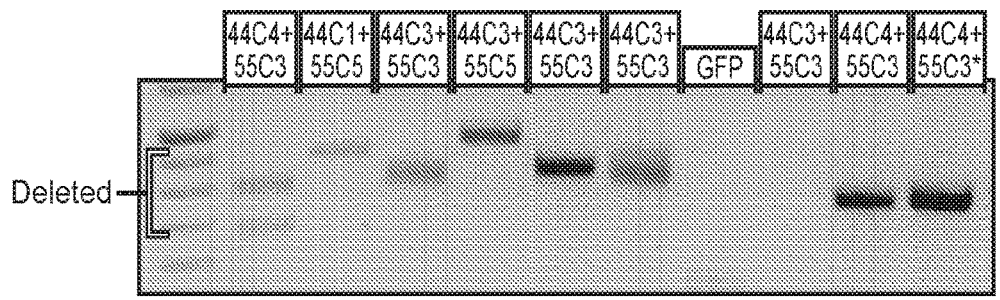
FIG. 5B
| CRISPR pair | Example sequences at rejoining |
|---|---|
| 44C1+55C3 | 9bp deletion, 151bp deletion w 16bp insertion |
| 44C1+55C5 | 17bp deletion |
| 44C3+55C5 | Seamless, 7bp deletion |
| 44C3+55C3 | 6bp deletion, 34bp deletion, 2bp insertion |
| 44C4+55C3 | Seamless, 1bp insertion, 2bp insertion 11bp deletion w 1bp insertion |
FIG. 5C
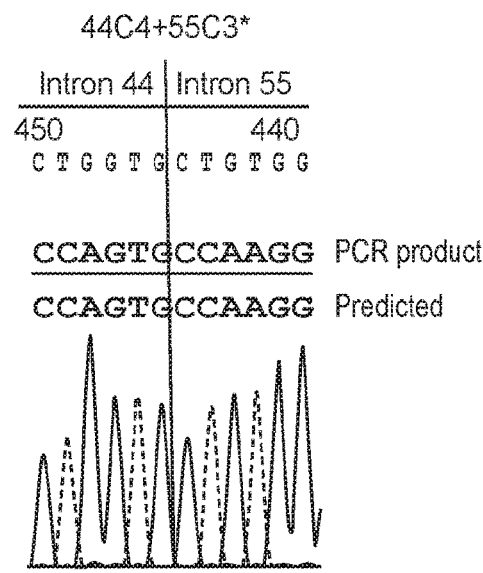
FIG. 5D
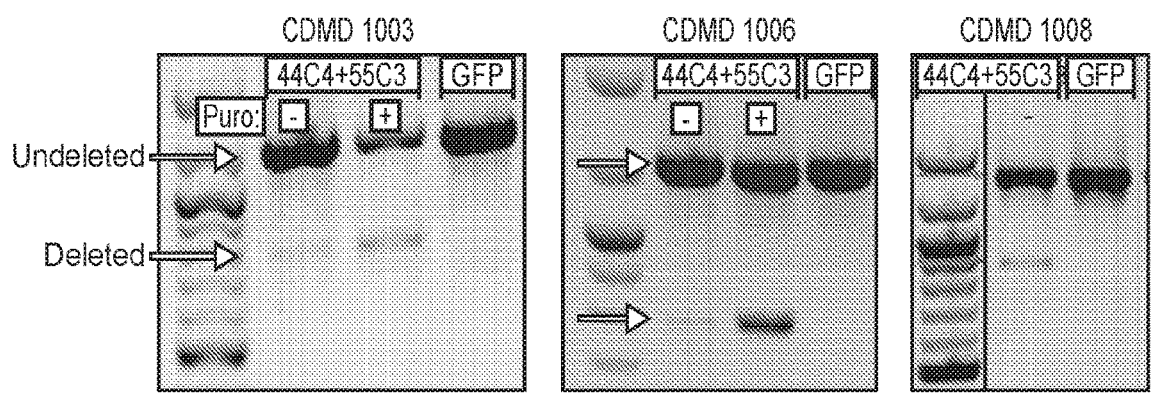

FIG. 8A
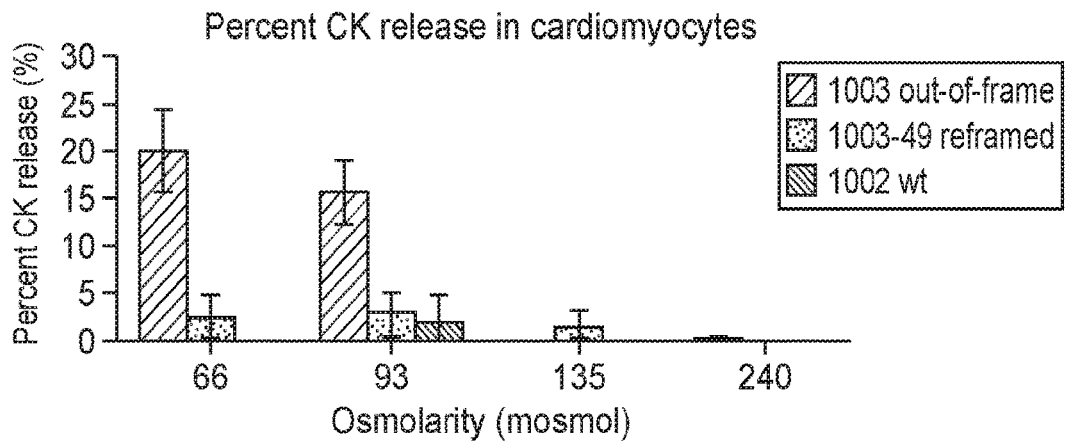
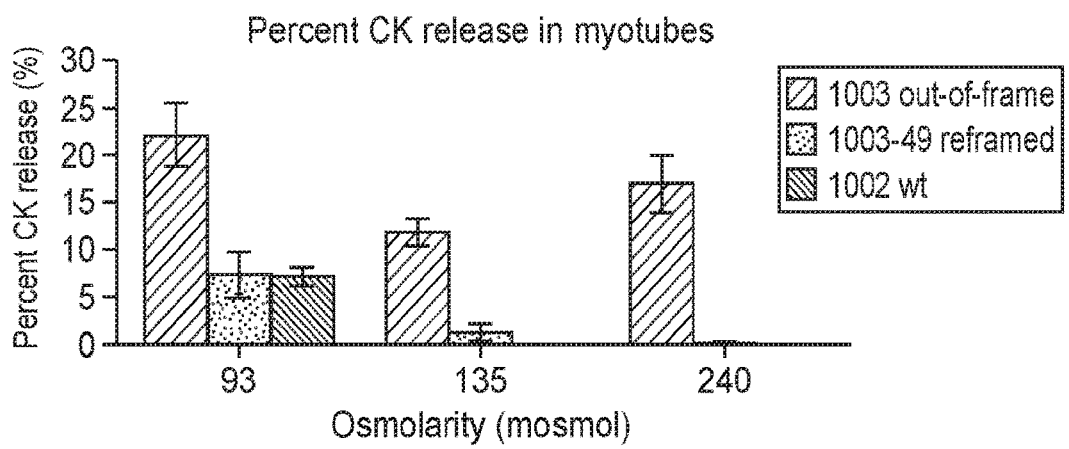
FIG. 8B
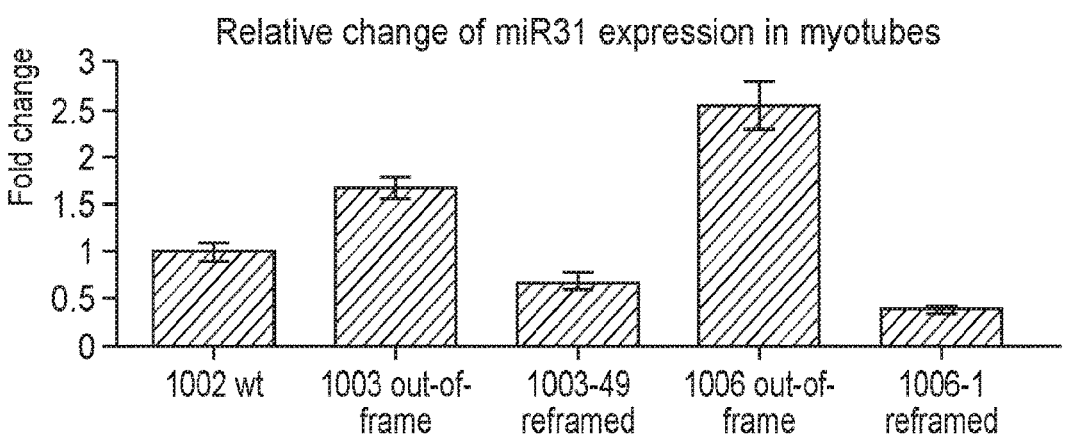

Double transfection in 293Ts
- Transfected total of 1µg plasmid (0.5µg each gRNA) in duplicate in HEK293FT cells as before

| gRNA combo | Sense/antisense | Total deletion distance (bp) | Distance from primers in PCR if deleted |
|---|---|---|---|
| 44C3 + SSC3 | Anti/Sense | 708,249 | 854bp |
| 44C3 + SSC2 | Anti/Anti | 708,296 | 807bp |
| 44C3 + SSCS | Anti/Sense | 708,142 | 961bp |
| 44C1+ SSC3 | Sense/Sense | 708,280 | 823bp |
| 44C1+ SSC2 | Sense/Anti | 708,327 | 776bp |
| 44C1+ SSCS | Sense/Sense | 708,173 | 930bp |

FIG. 11
293T exon 45-55 deletion
PCR with flanking primers amplifying rejoined region
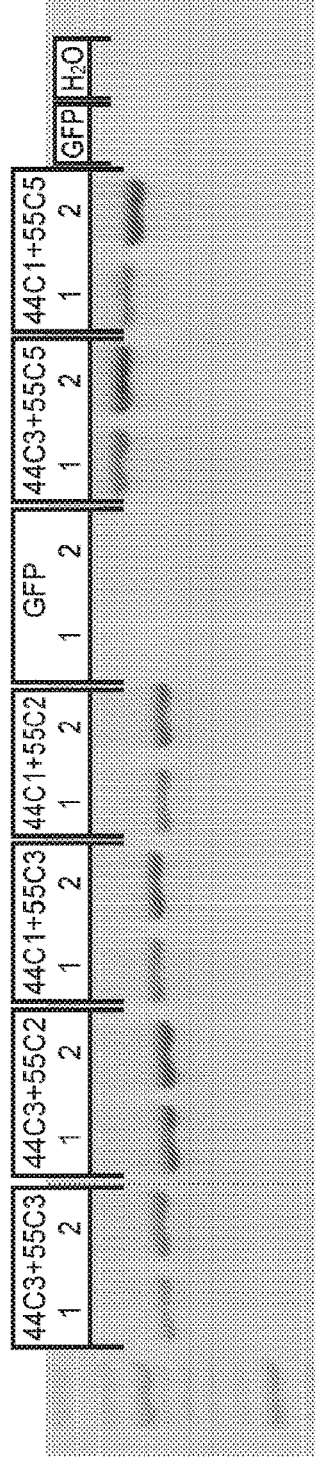
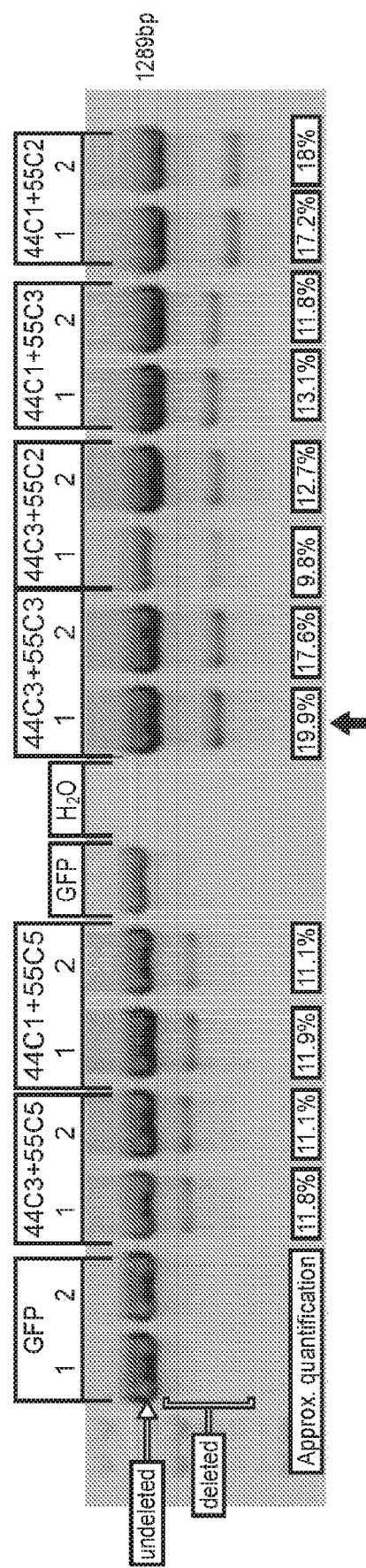

Paired transfection in 1006, 1003, 1008 multi del PCR repeat

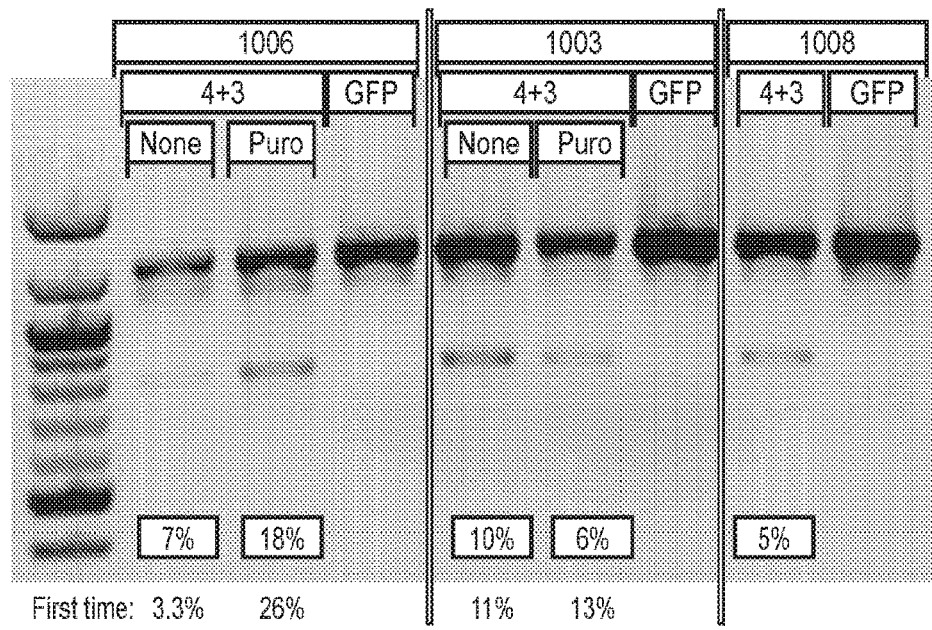

FIG. 18

| | 1006 | | | 1003 | | | 1008 | |
|---|---|---|---|---|---|---|---|---|
| | 4+3 | | GFP | 4+3 | | GFP | 4+3 | GFP |
| | None | Puro | | None | Puro | | | |
| | 7% | 18% | | 10% | 6% | | 5% | |
| First time: | 3.3% | 26% | | 11% | 13% | | | |

FIG. 19

Compiled activity of single guide cutting activity in HEK293FT cells

| Name | gRNA seq (wout PAM) | Tested in cells? | % cutting activity (Surveyor assay) |
|---|---|---|---|
| 44C1 | GTGGTGTCCTTTGAATATGC (SEQ ID NO:1140) | Y | 21 |
| 44C2 | AGATTGTCCAGGATATAATT (SEQ ID NO:1141) | Y | 17 |
| 44C3 | TTAGCAACCAAATTATATCC (SEQ ID NO: 1142) | Y | 24 |
| 44C4 | GTTGAAATTAAACTACACAC (SEQ ID NO: 1143) | Y | 24 |
| 44C5 | ATCTTTACCTGCATATTCAA (SEQ ID NO: 1144) | Y | 18 |
| 44C6md | CTCTGCATTGTTTTGGCCTC (SEQ ID NO: 1136) | Y | 0 |
| 44C7m | TCCTCCAAAGAGTAGAATGG (SEQ ID NO: 1137) | Y | 18 |
| 44C8m | GCCCTAAACTTACACTGTTC (SEQ ID NO: 1138) | Y | 0 |
| | | | |
| 55C1 | TACACATTTTTAGGCTTGAC (SEQ ID NO: 1160) | Y | 6 |
| 55C2 | CATTCCTGGGAGTCTGTCAT (SEQ ID NO:1161) | Y | 16 |
| 55C3 | TGTATGATGCTATAATACCA (SEQ ID NO:1162) | Y | 26 |
| 55C4 | GTGGAAAGTACATAGGACCT (SEQ ID NO:1163) | Y | 22 |
| 55C5 | TCTTATCATAACTCTTACCA (SEQ ID NO: 1164) | Y | 22 |
| 55C6d | AACTGTCAGTTGCATATTCC (SEQ ID NO: 1270) | Y | 0 |
| 55C7d | CAGAAAGGAATGCTGGTACC (SEQ ID NO:1271) | Y | 5 |
| 55C8d | TCTGCCTACACAATGAATGG (SEQ ID NO: 1272) | Y | 13 |
| 55C9d | CACAGATCAATCCAATTGTT (SEQ ID NO: 1273) | Y | 0 |

Deletion data for "44" guides

Only faint deletion, too low to quantify for 7+8 and 8+8

⇒ Undeleted
⇒ Deleted

FIG. 23

Table 2

| Intron | Site | | Length | Sequence | Followed by PAM | SEQ ID NO: |
|---|---|---|---|---|---|---|
| 44 | 1 (44C1) | Non-complementary strand of target sequence | 20nt | GTGGTGTCCTTTGAATATGC | AGG | 1140 |
| | | | 17nt | GTGTCCTTTGAATATGC | AGG | 1145 |
| | | Guide Sequence of Guide RNA | 20nt | GUGGUGUCCUUUGAAUAUGC | | 1150 |
| | | | 17nt | GUGUCCUUUGAAUAUGC | | 1155 |
| | 2 (44C2) | Non-complementary strand of target sequence | 20nt | AGATTGTCCAGGATATAATT | TGG | 1141 |
| | | | 17nt | TTGTCCAGGATATAATT | TGG | 1146 |
| | | Guide Sequence of Guide RNA | 20nt | AGAUUGUCCAGGAUAUAAUU | | 1151 |
| | | | 17nt | UUGUCCAGGAUAUAAUU | | 1156 |
| | 3 (44C3) | Non-complementary strand of target sequence | 20nt | TTAGCAACCAAATTATATCC | TGG | 1142 |
| | | | 17nt | GCAACCAAATTATATCC | TGG | 1147 |
| | | Guide Sequence of Guide RNA | 20nt | UUAGCAACCAAAUUAUAUCC | | 1152 |
| | | | 17nt | GCAACCAAAUUAUAUCC | | 1157 |
| | 4 (44C4) | Non-complementary strand of target sequence | 20nt | GTTGAAATTAAACTACACAC | TGG | 1143 |
| | | | 17nt | GAAATTAAACTACACAC | TGG | 1148 |
| | | Guide Sequence of Guide RNA | 20nt | GUUGAAAUUAAACUACACAC | | 1153 |
| | | | 17nt | GAAAUUAAACUACACAC | | 1158 |
| | 5 (44C5) | Non-complementary strand of target sequence | 20nt | ATCTTTACCTGCATATTCAA | AGG | 1144 |
| | | | 17nt | TTTACCTGCATATTCAA | AGG | 1149 |
| | | Guide Sequence of Guide RNA | 20nt | AUCUUUACCUGCAUAUUCAA | | 1154 |
| | | | 17nt | UUUACCUGCAUAUUCAA | | 1159 |
| 55 | 1 (55C1) | Non-complementary strand of target sequence | 20nt | TACACATTTTAGGCTTGAC | AGG | 1160 |
| | | | 17nt | ACATTTTAGGCTTGAC | AGG | 1165 |
| | | Guide Sequence of Guide RNA | 20nt | UACACAUUUUAGGCUUGAC | | 1170 |
| | | | 17nt | ACAUUUUAGGCUUGAC | | 1175 |
| | 2 (55C2) | Non-complementary strand of target sequence | 20nt | CATTCCTGGGAGTCTGTCAT | GGG | 1161 |
| | | | 17nt | TCCTGGGAGTCTGTCAT | GGG | 1166 |
| | | Guide Sequence of Guide RNA | 20nt | CAUUCCUGGGAGUCUGUCAU | | 1171 |
| | | | 17nt | UCCUGGGAGUCUGUCAU | | 1176 |
| | 3 (55C3) | Non-complementary strand of target sequence | 20nt | TGTATGATGCTATAATACCA | AGG | 1162 |
| | | | 17nt | ATGATGCTATAATACCA | AGG | 1167 |
| | | Guide Sequence of Guide RNA | 20nt | UGUAUGAUGCUAUAAUACCA | | 1172 |
| | | | 17nt | AUGAUGCUAUAAUACCA | | 1177 |
| | 4 (55C4) | Non-complementary strand of target sequence | 20nt | GTGGAAAGTACATAGGACCT | TGG | 1163 |
| | | | 17nt | GAAAGTACATAGGACCT | TGG | 1168 |
| | | Guide Sequence of Guide RNA | 20nt | GUGGAAAGUACAUAGGACCU | | 1173 |
| | | | 17nt | GAAAGUACAUAGGACCU | | 1178 |
| | 5 (55C5) | Non-complementary strand of target sequence | 20nt | TCTTATCATAACTCTTACCA | AGG | 1164 |
| | | | 17nt | TATCATAACTCTTACCA | AGG | 1169 |
| | | Guide Sequence of Guide RNA | 20nt | UCUUAUCAUAACUCUUACCA | | 1174 |
| | | | 17nt | UAUCAUAACUCUUACCA | | 1179 |

FIG. 24

Table 9

| Name | Target seq; gRNA seq (w/out PAM) | SEQ ID NO: |
|---|---|---|
| 44C1 | GTGGTGTCCTTTGAATATGC; GUGGUGUCCUUUGAAUAUGC | 1140 1150 |
| 44C2 | AGATTGTCCAGGATATAATT; AGAUUGUCCAGGAUAUAAUU | 1141 1151 |
| 44C3 | TTAGCAACCAAATTATATCC; UUAGCAACCAAAUUAUAUCC | 1142 1152 |
| 44C4 | GTTGAAATTAAACTACACAC; GUUGAAAUUAAACUACACAC | 1143 1153 |
| 44C5 | ATCTTTACCTGCATATTCAA; AUCUUUACCUGCAUAUUCAA | 1144 1154 |
| 44C6md | CTCTGCATTGTTTTGGCCTC; CUCUGCAUUGUUUUGGCCUC | 1136 1223 |
| 44C7m | TCCTCCAAAGAGTAGAATGG; UCCUCCAAAGAGUAGAAUGG | 1137 1224 |
| 44C8m | GCCCTAAACTTACACTGTTC; GCCCUAAACUUACACUGUUC | 1138 1225 |
| 44r1-3 | AAAGATAGATTAGATTGTCC; AAAGAUAGAUUAGAUUGUCC | 1139 1226 |
| 44r1-7 | GTTGCTAAATTACATAGTTT; GUUGCUAAAUUACAUAGUUU | 1180 1227 |
| 44r2-1 | TGTTGCAATAGTCAATCAAG; UGUUGCAAUAGUCAAUCAAG | 1181 1228 |
| 44r2-2 | ATACTGATTAAGACAGATGA; AUACUGAUUAAGACAGAUGA | 1182 1229 |
| 44r2-3 | AATACTGATTAAGACAGATG; AAUACUGAUUAAGACAGAUG | 1183 1230 |
| 44r3-1 | CTCTATACAAATGCCAACGC; CUCUAUACAAAUGCCAACGC | 1184 1231 |
| 44r3-2 | ACTTGCATGCACACCAGCGT; ACUUGCAUGCACACCAGCGU | 1185 1232 |
| 44r3-3 | TTGGGCTAATGTAGCATAAT; UUGGGCUAAUGUAGCAUAAU | 1186 1233 |
| 44r3-4 | GCGTTGGCATTTGTATAGAG; GCGUUGGCAUUUGUAUAGAG | 1187 1234 |
| 44r3-5 | TGGGCTAATGTAGCATAATG; UGGGCUAAUGUAGCAUAAUG | 1188 1235 |
| 44r3-6 | TTTGGGCTAATGTAGCATAA; UUUGGGCUAAUGUAGCAUAA | 1189 1236 |
| 44r3-7 | GCTTAACTCCTTAATATTAA; GCUUAACUCCUUAAUAUUAA | 1190 1237 |
| 44r3-8 | TCTTCTATATTAAAGCAGAT; UCUUCUAUAUUAAAGCAGAU | 1191 1238 |
| 44r3-9 | CTTCTATATTAAAGCAGATT; CUUCUAUAUUAAAGCAGAUU | 1192 1239 |
| 44r4-1 | AATATATAACTACCTTGGGT; AAUAUAUAACUACCUUGGGU | 1193 1240 |
| 44r4-2 | ACCTCCATTCTACTCTTTGG; | 1194 1241 |

FIG. 24 (Cont.)

| | ACCUCCAUUCUACUCUUUGG | |
|---|---|---|
| 44r4-3 | TTTCAATGATATCCAACCCA; UUUCAAUGAUAUCCAACCCA | 1195 1242 |
| 44r4-5 | AGTACCTCCATTCTACTCTT; AGUACCUCCAUUCUACUCUU | 1196 1243 |
| 44r4-6 | CTATCCTCCAAAGAGTAGAA; CUAUCCUCCAAAGAGUAGAA | 1197 1244 |
| 44r4-7 | TTTTGCTACATATTTCAGGC; UUUUGCUACAUAUUUCAGGC | 1198 1245 |
| 44r4-8 | TTTGCTACATATTTCAGGCT; UUUGCUACAUAUUUCAGGCU | 1199 1246 |
| 44r4-9 | GGGTTGGATATCATTGAAAA; GGGUUGGAUAUCAUUGAAAA | 1200 1247 |
| 44r4-10 | ATATTTCAGGCTGGGTTTCT; AUAUUUCAGGCUGGGUUUCU | 1201 1248 |
| 44r4-11 | TTGAAATATATAACTACCTT; UUGAAAUAUAUAACUACCUU | 1202 1249 |
| 44r4-12 | ATTGAAATATATAACTACCT; AUUGAAAUAUAUAACUACCU | 1203 1250 |
| 44r5-1 | GTGAGTAGTGGGGCACTTTA; GUGAGUAGUGGGGCACUUUA | 1204 1251 |
| 44r5-2 | TGTATGTAGAAGGTTAACTA; UGUAUGUAGAAGGUUAACUA | 1205 1252 |
| 44r5-3 | GAGCCTAATAAATGTACAAT; GAGCCUAAUAAAUGUACAAU | 1206 1253 |
| 44r5-4 | TTGTATGTAGAAGGTTAACT; UUGUAUGUAGAAGGUUAACU | 1207 1254 |
| 44r5-5 | CAATTTGTTTTGATGTAACT; CAAUUUGUUUUGAUGUAACU | 1208 1255 |
| 44r6-1 | TGCCTTCTGAAATAGTCCAG; UGCCUUCUGAAAUAGUCCAG | 1209 1256 |
| 44r6-3 | GTTAATAGGGAAACAGCATA; GUUAAUAGGGAAACAGCAUA | 1210 1257 |
| 44r6-4 | AACAATGCAGAGTTAATTGT; AACAAUGCAGAGUUAAUUGU | 1211 1258 |
| 44r7-1 | GAACATGTTGAGTAGACACA; GAACAUGUUGAGUAGACACA | 1212 1259 |
| 44r7-2 | TTTATCATCTGTGTCTATTC; UUUAUCAUCUGUGUCUAUUC | 1213 1260 |
| 44r7-3 | TCTTTACTTTCTTGACTATA; UCUUUACUUUCUUGACUAUA | 1214 1261 |
| 44r8-1 | AATATTCTCAAACCTCGTTC; AAUAUUCUCAAACCUCGUUC | 1215 1262 |
| 44r8-3 | ATTAACTGTGTTCCAGAACG; AUUAACUGUGUUCCAGAACG | 1216 1263 |
| 44r8-4 | TAACTGCTTCTTTGGATGAC; UAACUGCUUCUUUGGAUGAC | 1217 1264 |
| 44r8-5 | GACCAGAACAGTGTAAGTTT; GACCAGAACAGUGUAAGUUU | 1218 1265 |
| 44r8-6 | ACCAGAACAGTGTAAGTTTA; | 1219 1266 |

FIG. 24 (Cont.)

| | | |
|---|---|---|
| | ACCAGAACAGUGUAAGUUUA | |
| 44r8-7 | CTACTTTTTCCCCACTACTG;<br>CUACUUUUCCCCACUACUG | 1220<br>1267 |
| 44r8-8 | TGGAACACAGTTAATTCACT;<br>UGGAACACAGUUAAUUCACU | 1221<br>1268 |
| 44r8-9 | GTGTTGTTTAACTGCTTCTT;<br>GUGUUGUUUAACUGCUUCUU | 1222<br>1269 |
| 55C1 | TACACATTTTAGGCTTGAC;<br>UACACAUUUUAGGCUUGAC | 1160<br>1170 |
| 55C2 | CATTCCTGGGAGTCTGTCAT;<br>CAUUCCUGGGAGUCUGUCAU | 1161<br>1171 |
| 55C3 | TGTATGATGCTATAATACCA;<br>UGUAUGAUGCUAUAAUACCA | 1162<br>1172 |
| 55C4 | GTGGAAAGTACATAGGACCT;<br>GUGGAAAGUACAUAGGACCU | 1163<br>1173 |
| 55C5 | TCTTATCATAACTCTTACCA;<br>UCUUAUCAUAACUCUUACCA | 1164<br>1174 |
| 55C6d | AACTGTCAGTTGCATATTCC;<br>AACUGUCAGUUGCAUAUUCC | 1270<br>1318 |
| 55C7d | CAGAAAGGAATGCTGGTACC;<br>CAGAAAGGAAUGCUGGUACC | 1271<br>1319 |
| 55C8d | TCTGCCTACACAATGAATGG;<br>UCUGCCUACACAAUGAAUGG | 1272<br>1320 |
| 55C9d | CACAGATCAATCCAATTGTT;<br>CACAGAUCAAUCCAAUUGUU | 1273<br>1321 |
| 55r1-5 | TTGACAGGTGGAAAGTACAT;<br>UUGACAGGUGGAAAGUACAU | 1274<br>1322 |
| 55r1-6 | ACATTTTTAGGCTTGACAGG;<br>ACAUUUUUAGGCUUGACAGG | 1275<br>1323 |
| 55r1-8 | CTCTCCCATGACAGACTCCC;<br>CUCUCCCAUGACAGACUCCC | 1276<br>1324 |
| 55r1-9 | TTGGTAAGAGTTATGATAAG;<br>UUGGUAAGAGUUAUGAUAAG | 1277<br>1325 |
| 55r1-10 | AACACAAATTAAGTTCACCT;<br>AACACAAAUUAAGUUCACCU | 1278<br>1326 |
| 55r2-1 | AGGATCAGTGCTGTAGTGCC;<br>AGGAUCAGUGCUGUAGUGCC | 1279<br>1327 |
| 55r2-2 | GGCCGTTTATTATTATTGAC;<br>GGCCGUUUAUUAUUAUUGAC | 1280<br>1328 |
| 55r2-3 | TCTCAGGATTGCTATGCAAC;<br>UCUCAGGAUUGCUAUGCAAC | 1281<br>1329 |
| 55r2-4 | CAGGAAGACATACCATGTAA;<br>CAGGAAGACAUACCAUGUAA | 1282<br>1330 |
| 55r2-5 | AGCAGGGCTCTTTCAGTTTC;<br>AGCAGGGCUCUUUCAGUUUC; | 1283<br>1331 |
| 55r2-6 | TAACATTTTCAGCTTGAACC;<br>UAACAUUUUCAGCUUGAACC | 1284<br>1332 |
| 55r2-7 | TCAAGCTGAAAATGTTACAC;<br>UCAAGCUGAAAAUGUUACAC | 1285<br>1333 |

FIG. 24 (Cont.)

| | | |
|---|---|---|
| 55r2-8 | GTAACATTTTCAGCTTGAAC;<br>GUAACAUUUUCAGCUUGAAC | 1286<br>1334 |
| 55r2-9 | CAGAATGAATTTTGGAGCAC;<br>CAGAAUGAAUUUUGGAGCAC | 1287<br>1335 |
| 55r2-10 | TTTATTATTATTGACTGGTG;<br>UUUAUUAUUAUUGACUGGUG | 1288<br>1336 |
| 55r2-11 | AGAAGAATCTGACCTTTACA;<br>AGAAGAAUCUGACCUUUACA | 1289<br>1337 |
| 55r2-12 | GCAGGGCTCTTTCAGTTTCT;<br>GCAGGGCUCUUUCAGUUUCU | 1290<br>1338 |
| 55r3-1 | CTAAACAGTAGCCAGGCGTG;<br>CUAAACAGUAGCCAGGCGUG | 1291<br>1339 |
| 55r3-2 | CGCCTGGCTACTGTTTAGTG;<br>CGCCUGGCUACUGUUUAGUG | 1292<br>1340 |
| 55r3-3 | CTCCGCACTAAACAGTAGCC;<br>CUCCGCACUAAACAGUAGCC | 1293<br>1341 |
| 55r3-4 | GTAGCCAGGCGTGTGGATGT;<br>GUAGCCAGGCGUGUGGAUGU | 1294<br>1342 |
| 55r3-6 | CTTGGCTTTGACTATTCTGC;<br>CUUGGCUUUGACUAUUCUGC | 1295<br>1343 |
| 55r3-7 | AGTAGCCAGGCGTGTGGATG;<br>AGUAGCCAGGCGUGUGGAUG | 1296<br>1344 |
| 55r3-8 | TCCTCCCACATCCACACGCC;<br>UCCUCCCACAUCCACACGCC | 1297<br>1345 |
| 55r3-10 | TTGGCTTTGACTATTCTGCT;<br>UUGGCUUUGACUAUUCUGCU | 1298<br>1346 |
| 55r3-11 | ATAATGTCTCTGGCTTGTAA;<br>AUAAUGUCUCUGGCUUGUAA | 1299<br>1347 |
| 55r3-12 | TGGTACCCGGCAGCTCTCTG;<br>UGGUACCCGGCAGCUCUCUG | 1300<br>1348 |
| 55r3-13 | GTGGGAGGAACCTCAAAGAG;<br>GUGGGAGGAACCUCAAAGAG | 1301<br>1349 |
| 55r3-14 | TGACTATTCTGCTGGGAACA;<br>UGACUAUUCUGCUGGGAACA | 1302<br>1350 |
| 55r3-15 | CTCTCTGAGGAATGTTCCCT;<br>CUCUCUGAGGAAUGUUCCCU | 1303<br>1351 |
| 55r3-16 | AACATTCCTCAGAGAGCTGC;<br>AACAUUCCUCAGAGAGCUGC | 1304<br>1352 |
| 55r4-2 | ATTCTGAAGCTCCAAACAAT;<br>AUUCUGAAGCUCCAAACAAU | 1305<br>1353 |
| 55r4-3 | TAAATTACTCTGCTAAAGTA;<br>UAAAUUACUCUGCUAAAGUA | 1306<br>1354 |
| 55r5-1 | AGTACAAACCAGGTTTGTAC;<br>AGUACAAACCAGGUUUGUAC | 1307<br>1355 |
| 55r5-2 | ATATCCTTCCAGTACAAACC;<br>AUAUCCUUCCAGUACAAACC | 1308<br>1356 |
| 55r5-3 | CAAACCAGGTTTGTACTGGA;<br>CAAACCAGGUUUGUACUGGA | 1309<br>1357 |
| 55r5-4 | GGCAGCTAAAGCATCACTGA;<br>GGCAGCUAAAGCAUCACUGA | 1310<br>1358 |

FIG. 24 (Cont.)

| 55r5-5 | ATCTCTGAGTAGTACAAACC;<br>AUCUCUGAGUAGUACAAACC | 1311<br>1359 |
|---|---|---|
| 55r5-6 | GTGTCCCATTCTCTTTGACT;<br>GUGUCCCAUUCUCUUUGACU | 1312<br>1360 |
| 55r5-7 | TGTGTCCCATTCTCTTTGAC;<br>UGUGUCCCAUUCUCUUUGAC | 1313<br>1361 |
| 55r5-8 | TTCTGAATGTTGAACAAGTA;<br>UUCUGAAUGUUGAACAAGUA | 1314<br>1362 |
| 55r5-9 | GTCTCCAGTCAAAGAGAAT;<br>GUCUCCAGUCAAAGAGAAU | 1315<br>1363 |
| 55r5-10 | ATTCTCTTTGACTGGGAGAC;<br>AUUCUCUUUGACUGGGAGAC | 1316<br>1364 |
| 55r5-11 | TCTTTGACTGGGAGACAGGC;<br>UCUUUGACUGGGAGACAGGC | 1317<br>1365 |

The full sequence of the gRNA is the above sequence in the table plus the rest of the scaffold sequence below:

gttttagagctaGAAAtagcaagttaaaataaggctagtccgttatcaacttgaaaaagtggcaccgagtcggtgcTTTTTT

METHODS AND COMPOSITIONS FOR MODIFYING A MUTANT DYSTROPHIN GENE IN A CELL'S GENOME

CROSS-REFERENCE

This application claims the benefit of U.S. Provisional Patent Application No. 62/294,090, filed Feb. 11, 2016, which application is incorporated herein by reference in its entirety.

STATEMENT REGARDING FEDERALLY SPONSORED RESEARCH

This invention was made with Government support under grant number AR057230 and AR064327 awarded by the National Institutes of Health, and under grant number 1144087, awarded by the National Science Foundation. The Government has certain rights in the invention.

INCORPORATION BY REFERENCE OF SEQUENCE LISTING PROVIDED AS A TEXT FILE

A Sequence Listing is provided herewith as a text file, "UCLA-147WO_ST25.txt" created on Feb. 6, 2017 and having a size of 7,922 KB. The contents of the text file are incorporated by reference herein in their entirety.

INTRODUCTION

Dystrophin plays an important structural role in the muscle fiber, connecting the extracellular matrix and the cytoskeleton. The N-terminal region binds actin, whereas the C-terminal end is part of the dystrophin glycoprotein complex (DGC), which spans the sarcolemma. In the absence of functional dystrophin, mechanical stress leads to sarcolemmal ruptures, causing an uncontrolled influx of calcium into the muscle fiber interior, thereby triggering calcium-activated proteases and fiber necrosis.

Duchenne muscular dystrophy (DMD) is caused by a defect in the expression of dystrophin. The gene encoding dystrophin contains 79 exons spread out over more than 2 million nucleotides of DNA. Any exonic mutation that changes the reading frame of the exon, or introduces a stop codon, or is characterized by removal of an entire out of frame exon or exons or duplications of one or more exons has the potential to disrupt production of functional dystrophin, resulting in DMD. A frameshift in the DMD gene can result in the production of a truncated non-functional dystrophin protein, resulting in progressive muscle wasting and weakness.

SUMMARY

The present disclosure provides a method of modifying a mutant dystrophin gene in the genome of a cell. The present disclosure further provides compositions and kits for modifying a mutant dystrophin gene in the genome of a cell.

The present disclosure provides a method of modifying a mutant dystrophin gene in a cell's genome, the method comprising introducing into the cell: a) a class 2 CRISPR/Cas endonuclease, or a nucleic acid comprising a nucleotide sequence encoding the class 2 CRISPR/Cas endonuclease; and b) first and second CRISPR/Cas guide RNAs corresponding to the class 2 CRISPR/Cas endonuclease, or one or more nucleic acids comprising nucleotide sequences encoding the first and second CRISPR/Cas guide RNAs, wherein the first CRISPR/Cas guide RNA comprises a guide sequence that hybridizes to a target sequence within intron 44 of the mutant dystrophin gene, and the second CRISPR/Cas guide RNA comprises a guide sequence that hybridizes to a target sequence within intron 55 of the mutant dystrophin gene, and wherein said introducing results in deletion of a greater than 330-kilobase region of the mutant dystrophin gene comprising exons 45-55. In some cases, the class 2 CRISPR/Cas endonuclease is a type II CRISPR/Cas endonuclease. In some cases, the class 2 CRISPR/Cas endonuclease is a Cas9 protein and the corresponding CRISPR/Cas guide RNA is a Cas9 guide RNA. In some cases, the class 2 CRISPR/Cas endonuclease is a type V or type VI CRISPR/Cas endonuclease. In some cases, the class 2 CRISPR/Cas endonuclease is a Cpf1 protein, a C2c1 protein, a C2c3 protein, or a C2c2 protein. In some cases, the guide sequence of the first CRISPR/Cas guide RNA (e.g., a Cas9 guide RNA) comprises the 17 nucleotide sequence set forth in any of SEQ ID NOs: 1155-1159. In some cases, the guide sequence of the first CRISPR/Cas guide RNA (e.g., a Cas9 guide RNA) comprises the 20 nucleotide sequence set forth in any of SEQ ID NOs: 1150-1154. In some cases, the guide sequence of the second CRISPR/Cas guide RNA (e.g., a Cas9 guide RNA) comprises the 17 nucleotide sequence set forth in any of SEQ ID NOs: 1175-1179. In some cases, the guide sequence of the second CRISPR/Cas guide RNA (e.g., a Cas9 guide RNA) comprises the 20 nucleotide sequence set forth in any of SEQ ID NOs: 1170-1174. In some cases, the guide sequence of the first CRISPR/Cas guide RNA (e.g., a Cas9 guide RNA) comprises the 17 nucleotide sequence GAAAUUAAACUACACAC (SEQ ID NO: 1158), and the guide sequence of the second CRISPR/Cas guide RNA (e.g., a Cas9 guide RNA) comprises the 17 nucleotide sequence AUGAUGCUAUAAUACCA (SEQ ID NO: 1177). In some cases, the guide sequence of the first CRISPR/Cas guide RNA (e.g., a Cas9 guide RNA) comprises the 20 nucleotide sequence GUUGAAAUUAAAC-UACACAC (SEQ ID NO: 1153) and the guide sequence of the second CRISPR/Cas guide RNA (e.g., a Cas9 guide RNA) comprises the 20 nucleotide sequence UGUAUGAUGCUAUAAUACCA (SEQ ID NO: 1172). In some cases, the target sequence within intron 44 and the target sequence within intron 55 are separated from each other by 500 kb or more. In some cases, the target sequence within intron 44 and the target sequence within intron 55 are separated from each other by 700 kb or more. In some cases, the cell is in vitro. In some cases, the cell is ex vivo. In some cases, the cell is in vivo. In some cases, the cell is a muscle cell. In some cases, the muscle cell derived from an induced pluripotent stem (iPS) cell. In some cases, the cell is a stem cell. In some cases, the stem cell is an induced pluripotent stem (iPS) cell. In some cases, the cell is a pericyte. In some cases, the cell is a type 2 pericyte. In some cases, is a muscle stem cell. In some cases, the cell is a myogenic precursor cell. In some cases, the method includes, after the introducing step, a step of transplanting the cell into an individual (e.g., an individual having DMD). In some cases, the cell is autologous to the individual. Where the stem cell is an iPS cell, in some cases, the method comprises, after said introducing step, a step of inducing the iPS cell to differentiate into a muscle cell. Where the stem cell is an iPS cell, in some cases, the method comprises, after said introducing step, a step of inducing the iPS cell to differentiate into a muscle cell; and transplanting the differentiated muscle cell into an individual (e.g., an individual having DMD).

The present disclosure provides a kit for modifying a mutant dystrophin gene in a cell's genome, the kit comprising: (i) a first CRISPR/Cas guide RNA (e.g., a Cas9 guide RNA) comprising a guide sequence having 100% complementarity over 17 or more contiguous nucleotides with a target sequence corresponding to intron 44 of the human dystrophin gene, and (ii) a second CRISPR/Cas guide RNA (e.g., a Cas9 guide RNA) comprising a guide sequence having 100% complementarity over 17 or more contiguous nucleotides with a target sequence corresponding to intron 55 of the human dystrophin gene, wherein the target sequence within intron 44 and the target sequence within intron 55 are separated from each other by greater than 330 kb. In some cases, the guide sequence of the first CRISPR/Cas guide RNA (e.g., a Cas9 guide RNA) comprises the 17 nucleotide sequence set forth in any of SEQ ID NOs: 1155-1159. In some cases, the guide sequence of the first CRISPR/Cas guide RNA (e.g., a Cas9 guide RNA) comprises the 20 nucleotide sequence set forth in any of SEQ ID NOs: 1150-1154. In some cases, the guide sequence of the second CRISPR/Cas guide RNA (e.g., a Cas9 guide RNA) comprises the 17 nucleotide sequence set forth in any of SEQ ID NOs: 1175-1179. In some cases, the guide sequence of the second CRISPR/Cas guide RNA (e.g., a Cas9 guide RNA) comprises the 20 nucleotide sequence set forth in any of SEQ ID NOs: 1170-1174. In some cases, the guide sequence of the first CRISPR/Cas guide RNA (e.g., a Cas9 guide RNA) comprises the 17 nucleotide sequence GAAAUUAAACUACACAC (SEQ ID NO: 1158), and the guide sequence of the second CRISPR/Cas guide RNA (e.g., a Cas9 guide RNA) comprises the 17 nucleotide sequence AUGAUGCUAUAAUACCA (SEQ ID NO: 1177). In some cases, the guide sequence of the first CRISPR/Cas guide RNA (e.g., a Cas9 guide RNA) comprises the 20 nucleotide sequence GUUGAAAUUAAACUACACAC (SEQ ID NO: 1153) and the guide sequence of the second CRISPR/Cas guide RNA (e.g., a Cas9 guide RNA) comprises the 20 nucleotide sequence UGUAUGAUGCUAUAAUACCA (SEQ ID NO: 1172). In some cases, the guide sequence of the first CRISPR/Cas guide RNA (e.g., a Cas9 guide RNA) has 100% complementarity over 20 contiguous nucleotides with a target sequence corresponding to intron 44 of the human dystrophin gene, and the guide sequence of the second CRISPR/Cas guide RNA (e.g., a Cas9 guide RNA) has 100% complementarity over 20 contiguous nucleotides with a target sequence corresponding to intron 55 of the human dystrophin gene. In some cases, the target sequence corresponding to intron 44 and the target sequence corresponding to intron 55 are separated from each other by 500 kb or more. In some cases, the target sequence within intron 44 and the target sequence within intron 55 are separated from each other by 700 kb or more. In some cases, the kit further comprises a class 2 CRISPR/Cas endonuclease, or a nucleic acid comprising a nucleotide sequence encoding the class 2 CRISPR/Cas endonuclease. In some cases, the class 2 CRISPR/Cas endonuclease is a Cas9 protein. In some cases, the first and second CRISPR/Cas guide RNAs are Cas9 guide RNAs. In some cases, the first and second CRISPR/Cas guide RNAs are single molecule CRISPR/Cas guide RNAs.

The present disclosure provides a method of treating Duchenne muscular dystrophy in an individual, the method comprising: a) modifying a mutant dystrophin gene in the genome of a cell obtained from the individual, the method comprising introducing into the cell in vitro: i) a class 2 CRISPR/Cas endonuclease, or a nucleic acid comprising a nucleotide sequence encoding the class 2 CRISPR/Cas endonuclease; and ii) first and second CRISPR/Cas guide RNAs corresponding to the class 2 CRISPR/Cas endonuclease, or one or more nucleic acids comprising nucleotide sequences encoding the first and second CRISPR/Cas guide RNAs, wherein the first CRISPR/Cas guide RNA comprises a guide sequence that hybridizes to a target sequence within intron 44 of the mutant dystrophin gene, and the second CRISPR/Cas guide RNA comprises a guide sequence that hybridizes to a target sequence within intron 55 of the mutant dystrophin gene, and wherein said introducing results in deletion of a greater than 330-kilobase region of the mutant dystrophin gene comprising exons 45-55, thereby producing a modified cell; and b) introducing the modified cell at or near a treatment site in the individual, or introducing the modified cell systemically into the individual. In some cases, the treatment site is in or around a muscle. In some cases, introducing the modified cell systemically comprises intravenous administration of the modified cell. In some cases, the cell is a muscle cell. In some cases, the cell is a pericyte. In some cases, the muscle cell derived from an induced pluripotent stem (iPS) cell. In some cases, the cell is a stem cell. In some cases, the stem cell is an induced pluripotent stem (iPS) cell. In some cases, the individual is a human. In some cases, the class 2 CRISPR/Cas endonuclease is a type II CRISPR/Cas endonuclease. In some cases, the class 2 CRISPR/Cas endonuclease is a Cas9 protein and the corresponding CRISPR/Cas guide RNA is a Cas9 guide RNA. In some cases, the class 2 CRISPR/Cas endonuclease is a type V or type VI CRISPR/Cas endonuclease. In some cases, the class 2 CRISPR/Cas endonuclease is a Cpf1 protein, a C2c1 protein, a C2c3 protein, or a C2c2 protein. In some cases, the guide sequence of the first CRISPR/Cas guide RNA comprises the 17-nucleotide sequence set forth in any of SEQ ID NOs: 1155-1159. In some cases, the guide sequence of the first CRISPR/Cas guide RNA comprises the 20 nucleotide sequence set forth in any of SEQ ID NOs: 1150-1154. In some cases, the guide sequence of the second CRISPR/Cas guide RNA comprises the 17 nucleotide sequence set forth in any of SEQ ID NOs: 1175-1179. In some cases, the guide sequence of the second CRISPR/Cas guide RNA comprises the 20 nucleotide sequence set forth in any of SEQ ID NOs: 1170-1174. In some cases, the guide sequence of the first CRISPR/Cas guide RNA comprises the 17 nucleotide sequence GAAAUUAAACUACACAC (SEQ ID NO: 1158), and the guide sequence of the second CRISPR/Cas guide RNA comprises the 17 nucleotide sequence AUGAUGCUAUAAUACCA (SEQ ID NO: 1177). In some cases, the guide sequence of the first CRISPR/Cas guide RNA comprises the 20 nucleotide sequence GUUGAAAUUAAACUACACAC (SEQ ID NO: 1153) and the guide sequence of the second CRISPR/Cas guide RNA comprises the 20 nucleotide sequence UGUAUGAUGCUAUAAUACCA (SEQ ID NO: 1172). In some cases, the target sequence within intron 44 and the target sequence within intron 55 are separated from each other by 500 kb or more. In some cases, the target sequence within intron 44 and the target sequence within intron 55 are separated from each other by 700 kb or more.

BRIEF DESCRIPTION OF THE DRAWINGS

FIGS. 1A-1D depict the generation of CDMD hiPSC lines.

FIGS. 2A-2C depict the generation of CDMD hiPSC lines with an exon 45-55 deletion.

FIGS. 5A-5D depict the effect of nucleofection of paired gRNAs in CDMD hiPSCs.

FIGS. 8A-8F depict in vitro and in vivo function of reframed CDMD hiPSC-derived cardiomyocytes and skeletal muscle cells.

FIG. 11 depicts gels showing successful genomic deletion with various pairs of guide RNAs in 293T cells.

FIG. 18 depicts a gel showing successful genomic deletion with a pair of guide RNAs.

FIG. 19 depicts the cutting activity using guide RNAs of the target sequences within intron 44 or the guide RNAs of the target sequences within intron 55 of the mutant dystrophin gene in HEK293FT cells.

FIG. 23 provides Table 2, which provides example guide sequences of guide RNAs and non-complementary strands of target sequences that can be used to accomplish genomic deletion of a mutant dystrophin gene in human cells.

FIG. 24 provides Table 9, which provides example guide sequences of guide RNAs and non-complementary strands of target sequences that can be used to accomplish genomic deletions of a mutant dystrophin gene in human cells.

DEFINITIONS

Figure 1A:
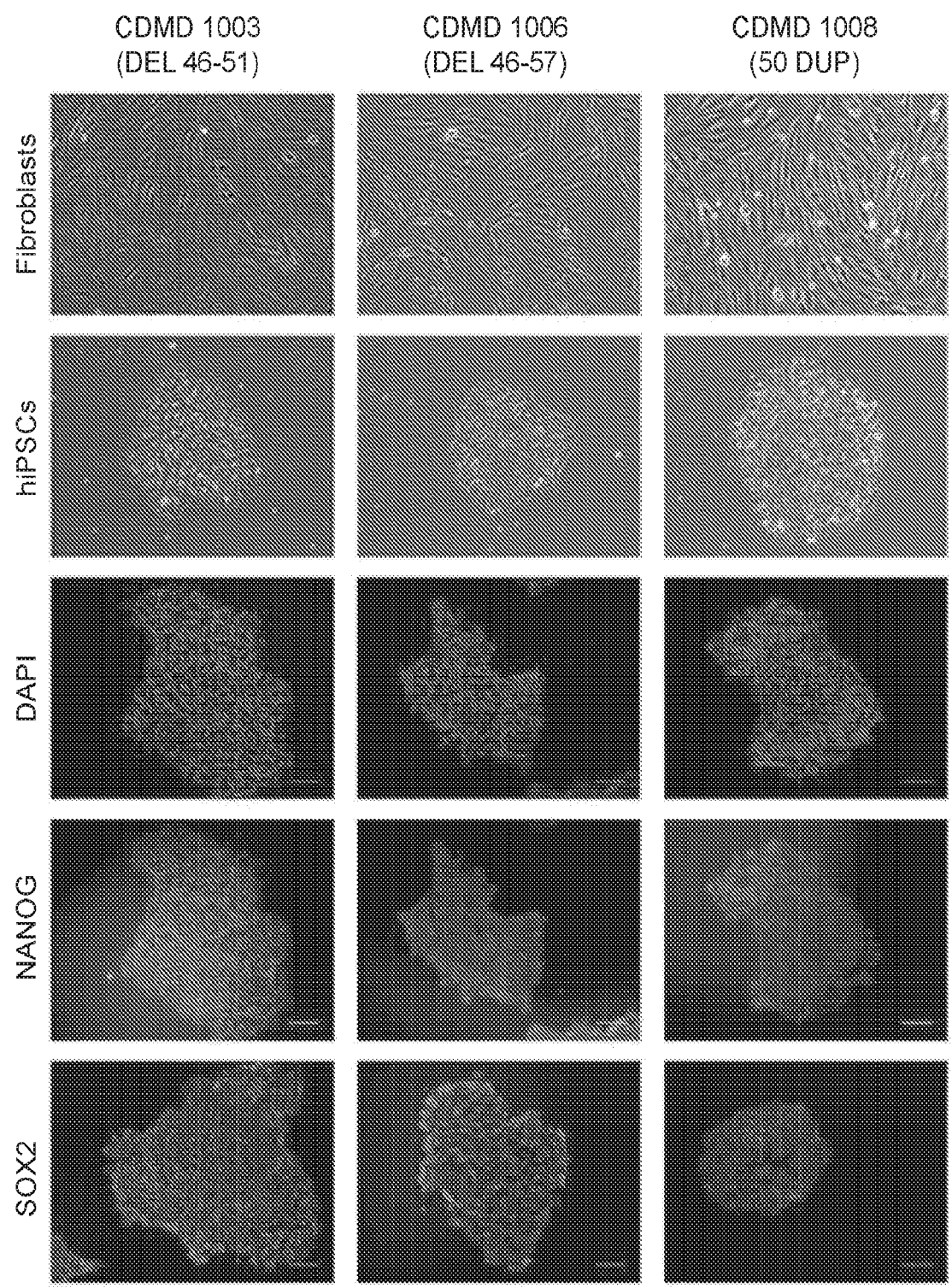

The terms "polynucleotide" and "nucleic acid," used interchangeably herein, refer to a polymeric form of nucleotides of any length, either ribonucleotides or deoxyribonucleotides. Thus, this term includes, but is not limited to, single-, double-, or multi-stranded DNA or RNA, genomic DNA, cDNA, DNA-RNA hybrids, or a polymer comprising purine and pyrimidine bases or other natural, chemically or biochemically modified, non-natural, or derivatized nucleotide bases.

By "hybridizable" or "complementary" or "substantially complementary" it is meant that a nucleic acid (e.g. RNA, DNA) comprises a sequence of nucleotides that enables it to non-covalently bind, i.e. form Watson-Crick base pairs and/or G/U base pairs, "anneal", or "hybridize," to another nucleic acid in a sequence-specific, antiparallel, manner (i.e., a nucleic acid specifically binds to a complementary nucleic acid) under the appropriate in vitro and/or in vivo conditions of temperature and solution ionic strength. Standard Watson-Crick base-pairing includes: adenine (A) pairing with thymidine (T), adenine (A) pairing with uracil (U), and guanine (G) pairing with cytosine (C) [DNA, RNA]. In addition, for hybridization between two RNA molecules (e.g., dsRNA), and for hybridization of a DNA molecule with an RNA molecule (e.g., when a DNA target nucleic acid base pairs with a guide RNA, etc.): guanine (G) can also base pair with uracil (U). For example, G/U base-pairing is partially responsible for the degeneracy (i.e., redundancy) of the genetic code in the context of tRNA anti-codon base-pairing with codons in mRNA. Thus, in the context of this disclosure, a guanine (G) (e.g., of a protein-binding segment (dsRNA duplex) of a guide RNA molecule; of a target nucleic acid base pairing with a guide RNA, etc.) is considered complementary to both a uracil (U) and to an adenine (A). For example, when a G/U base-pair can be made at a given nucleotide position of a protein-binding segment (e.g., dsRNA duplex) of a guide RNA molecule, the position is not considered to be non-complementary, but is instead considered to be complementary.

Hybridization and washing conditions are well known and exemplified in Sambrook, J., Fritsch, E. F. and Maniatis, T. Molecular Cloning: A Laboratory Manual, Second Edition, Cold Spring Harbor Laboratory Press, Cold Spring Harbor (1989), particularly Chapter 11 and Table 11.1 therein; and Sambrook, J. and Russell, W., Molecular Cloning: A Laboratory Manual, Third Edition, Cold Spring Harbor Laboratory Press, Cold Spring Harbor (2001). The conditions of temperature and ionic strength determine the "stringency" of the hybridization.

Hybridization requires that the two nucleic acids contain complementary sequences, although mismatches between bases are possible. The conditions appropriate for hybridization between two nucleic acids depend on the length of the nucleic acids and the degree of complementarity, variables well known in the art. The greater the degree of complementarity between two nucleotide sequences, the greater the value of the melting temperature (Tm) for hybrids of nucleic acids having those sequences. For hybridizations between nucleic acids with short stretches of complementarity (e.g. complementarity over 35 or less, 30 or less, 25 or less, 22 or less, 20 or less, or 18 or less nucleotides) the position of mismatches can become important (see Sambrook et al., supra, 11.7-11.8). Typically, the length for a hybridizable nucleic acid is 8 nucleotides or more (e.g., 10 nucleotides or more, 12 nucleotides or more, 15 nucleotides or more, 20 nucleotides or more, 22 nucleotides or more, 25 nucleotides or more, or 30 nucleotides or more). Temperature, wash solution salt concentration, and other conditions may be adjusted as necessary according to factors such as length of the region of complementation and the degree of complementation.

It is understood that the sequence of a polynucleotide need not be 100% complementary to that of its target nucleic acid to be specifically hybridizable or hybridizable. Moreover, a polynucleotide may hybridize over one or more segments such that intervening or adjacent segments are not involved in the hybridization event (e.g., a bulge, a loop structure or hairpin structure, etc.). A polynucleotide can comprise 60% or more, 65% or more, 70% or more, 75% or more, 80% or more, 85% or more, 90% or more, 95% or more, 98% or more, 99% or more, 99.5% or more, or 100% sequence complementarity to a target region within the target nucleic acid sequence to which it will hybridize. For example, an antisense nucleic acid in which 18 of 20 nucleotides of the antisense compound are complementary to a target region, and would therefore specifically hybridize, would represent 90 percent complementarity. In this example, the remaining noncomplementary nucleotides may be clustered or interspersed with complementary nucleotides and need not be contiguous to each other or to complementary nucleotides. Percent complementarity between particular stretches of nucleic acid sequences within nucleic acids can be determined using any convenient method. Example methods include BLAST programs (basic local alignment search tools) and PowerBLAST programs (Altschul et al., J. Mol. Biol., 1990, 215, 403-410; Zhang and Madden, Genome Res., 1997, 7, 649-656), the Gap program (Wisconsin Sequence Analysis Package, Version 8 for Unix, Genetics Computer Group, University Research Park, Madison Wis.), e.g., using default settings, which uses the algorithm of Smith and Waterman (Adv. Appl. Math., 1981, 2, 482-489), and the like.

The terms "peptide," "polypeptide," and "protein" are used interchangeably herein, and refer to a polymeric form of amino acids of any length, which can include coded and non-coded amino acids, chemically or biochemically modified or derivatized amino acids, and polypeptides having modified peptide backbones.

"Binding" as used herein (e.g. with reference to an RNA-binding domain of a polypeptide, binding to a target nucleic acid, and the like) refers to a non-covalent interaction between macromolecules (e.g., between a protein and a nucleic acid; between a Cas9 protein/guide RNA complex and a target nucleic acid; and the like). While in a state of non-covalent interaction, the macromolecules are said to be "associated" or "interacting" or "binding" (e.g., when a molecule X is said to interact with a molecule Y, it is meant the molecule X binds to molecule Y in a non-covalent manner). Not all components of a binding interaction need be sequence-specific (e.g., contacts with phosphate residues in a DNA backbone), but some portions of a binding interaction may be sequence-specific. Binding interactions are generally characterized by a dissociation constant ($K_D$) of less than $10^{-6}$ M, less than $10^{-7}$ M, less than $10^{-8}$ M, less than $10^{-9}$ M, less than $10^{-10}$ M, less than $10^{-11}$ M, less than $10^{-12}$ M, less than $10^{-13}$ M, less than $10^{-14}$ M, or less than $10^{-15}$ M. "Affinity" refers to the strength of binding, increased binding affinity being correlated with a lower $K_D$.

By "binding domain" it is meant a protein domain that is able to bind non-covalently to another molecule. A binding domain can bind to, for example, a DNA molecule (a DNA-binding domain), an RNA molecule (an RNA-binding domain) and/or a protein molecule (a protein-binding domain). In the case of a protein having a protein-binding domain, it can in some cases bind to itself (to form homodimers, homotrimers, etc.) and/or it can bind to one or more regions of a different protein or proteins.

The term "conservative amino acid substitution" refers to the interchangeability in proteins of amino acid residues having similar side chains. For example, a group of amino acids having aliphatic side chains consists of glycine, alanine, valine, leucine, and isoleucine; a group of amino acids having aliphatic-hydroxyl side chains consists of serine and threonine; a group of amino acids having amide containing side chains consisting of asparagine and glutamine; a group of amino acids having aromatic side chains consists of phenylalanine, tyrosine, and tryptophan; a group of amino acids having basic side chains consists of lysine, arginine, and histidine; a group of amino acids having acidic side chains consists of glutamate and aspartate; and a group of amino acids having sulfur containing side chains consists of cysteine and methionine. Exemplary conservative amino acid substitution groups are: valine-leucine-isoleucine, phenylalanine-tyrosine, lysine-arginine, alanine-valine-glycine, and asparagine-glutamine.

A polynucleotide or polypeptide has a certain percent "sequence identity" to another polynucleotide or polypeptide, meaning that, when aligned, that percentage of bases or amino acids are the same, and in the same relative position, when comparing the two sequences. Sequence identity can be determined in a number of different ways. To determine sequence identity, sequences can be aligned using various convenient methods and computer programs (e.g., BLAST, T-COFFEE, MUSCLE, MAFFT, etc.), available over the world wide web at sites including ncbi.nlm.nili.gov/BLAST, ebi.ac.uk/Tools/msa/tcoffee/, ebi.ac.uk/Tools/msa/muscle/, mafft.cbrc.jp/alignment/software/. See, e.g., Altschul et al. (1990), J. Mol. Bioi. 215:403-10.

A DNA sequence that "encodes" a particular RNA is a DNA nucleic acid sequence that is transcribed into RNA. A DNA polynucleotide may encode an RNA (mRNA) that is translated into protein (and therefore the DNA and the mRNA both encode the protein), or a DNA polynucleotide may encode an RNA that is not translated into protein (e.g. tRNA, rRNA, microRNA (miRNA), a "non-coding" RNA (ncRNA), a guide RNA, etc.).

A "protein coding sequence" or a sequence that encodes a particular protein or polypeptide, is a nucleic acid sequence that is transcribed into mRNA (in the case of DNA) and is translated (in the case of mRNA) into a polypeptide in vitro or in vivo when placed under the control of appropriate regulatory sequences. The boundaries of the coding sequence are determined by a start codon at the 5' terminus (N-terminus) and a translation stop nonsense codon at the 3' terminus (C-terminus). A coding sequence can include, but is not limited to, cDNA from prokaryotic or eukaryotic mRNA, genomic DNA sequences from prokaryotic or eukaryotic DNA, and synthetic nucleic acids. A transcription termination sequence will usually be located 3' to the coding sequence.

The terms "DNA regulatory sequences," "control elements," and "regulatory elements," used interchangeably herein, refer to transcriptional and translational control sequences, such as promoters, enhancers, polyadenylation signals, terminators, protein degradation signals, and the like, that provide for and/or regulate transcription of a non-coding sequence (e.g., guide RNA) or a coding sequence (e.g., a class 2 CRISPR/Cas endonuclease such as a Cas9 protein) and/or regulate translation of an encoded polypeptide.

As used herein, a "promoter sequence" is a DNA regulatory region capable of binding RNA polymerase and initiating transcription of a downstream (3' direction) coding or non-coding sequence. For purposes of the present disclosure, the promoter sequence is bounded at its 3' terminus by the transcription initiation site and extends upstream (5' direction) to include the minimum number of bases or elements necessary to initiate transcription at levels detectable above background. Within the promoter sequence will be found a transcription initiation site, as well as protein binding domains responsible for the binding of RNA polymerase. Eukaryotic promoters will often, but not always, contain "TATA" boxes and "CAT" boxes. Various promoters, including inducible promoters, may be used to drive the various vectors of the present disclosure.

The term "naturally-occurring" or "unmodified" or "wild type" as used herein as applied to a nucleic acid, a polypeptide, a cell, or an organism, refers to a nucleic acid, polypeptide, cell, or organism that is found in nature. For example, a polypeptide or polynucleotide sequence that is present in an organism (including viruses) that can be isolated from a source in nature and which has not been intentionally modified by a human in the laboratory is wild type (and naturally occurring).

The term "chimeric" as used herein as applied to a nucleic acid or polypeptide refers to two components that are defined by structures derived from different sources. For example, where "chimeric" is used in the context of a chimeric polypeptide (e.g., a chimeric Cas9 protein), the chimeric polypeptide includes amino acid sequences that are derived from different polypeptides. A chimeric polypeptide may comprise either modified or naturally-occurring polypeptide sequences (e.g., a first amino acid sequence from a modified or unmodified Cas9 protein; and a second amino acid sequence, e.g., a sequence from another species of Cas9, a sequence from a protein other than a Cas9 protein, etc.). Similarly, "chimeric" in the context of a polynucleotide encoding a chimeric polypeptide includes nucleotide sequences derived from different coding regions (e.g., a first nucleotide sequence encoding a modified or unmodified Cas9 protein; and a second nucleotide sequence encoding a polypeptide other than a Cas9 protein).

The term "chimeric polypeptide" refers to a polypeptide which is made by the combination (i.e., "fusion") of two otherwise separated segments of amino sequence, usually through human intervention. A polypeptide that comprises a chimeric amino acid sequence is a chimeric polypeptide.

"Heterologous," as used herein, means a nucleotide or polypeptide sequence that is not found in the native nucleic acid or protein, respectively. For example, in a chimeric Cas9 protein, the RNA-binding domain of a naturally-occurring bacterial Cas9 polypeptide (or a variant thereof) may be fused to a heterologous polypeptide sequence (i.e. a polypeptide sequence from a protein other than Cas9 or a polypeptide sequence from another organism). The heterologous polypeptide sequence may exhibit an activity (e.g., enzymatic activity) that will also be exhibited by the chimeric Cas9 protein (e.g., methyltransferase activity, acetyltransferase activity, kinase activity, ubiquitinating activity, etc.). A heterologous nucleic acid sequence may be linked to a naturally-occurring nucleic acid sequence (or a variant thereof) (e.g., by genetic engineering) to generate a chimeric nucleotide sequence encoding a chimeric polypeptide. As another example, in a fusion variant Cas9 polypeptide, a variant Cas9 polypeptide may be fused to a heterologous polypeptide (i.e. a polypeptide other than Cas9), which exhibits an activity that will also be exhibited by the fusion variant Cas9 polypeptide. A heterologous nucleic acid sequence may be linked to a variant Cas9 polypeptide (e.g., by genetic engineering) to generate a nucleotide sequence encoding a fusion protein.

"Recombinant," as used herein, means that a particular nucleic acid (DNA or RNA) is the product of various combinations of cloning, restriction, polymerase chain reaction (PCR) and/or ligation steps resulting in a construct having a structural coding or non-coding sequence distinguishable from endogenous nucleic acids found in natural systems. DNA sequences encoding polypeptides can be assembled from cDNA fragments or from a series of synthetic oligonucleotides, to provide a synthetic nucleic acid which is capable of being expressed from a recombinant transcriptional unit contained in a cell or in a cell-free transcription and translation system. Genomic DNA comprising the relevant sequences can also be used in the formation of a recombinant gene or transcriptional unit. Sequences of non-translated DNA may be present 5' or 3' from the open reading frame, where such sequences do not interfere with manipulation or expression of the coding regions, and may indeed act to modulate production of a desired product by various mechanisms. Alternatively, DNA sequences encoding RNA (e.g., guide RNA) that is not translated may also be considered recombinant. Thus, e.g., the term "recombinant" nucleic acid refers to one which is not naturally occurring, e.g., is made by the artificial combination of two otherwise separated segments of sequence through human intervention. This artificial combination is often accomplished by either chemical synthesis means, or by the artificial manipulation of isolated segments of nucleic acids, e.g., by genetic engineering techniques. Such is usually done to replace a codon with a codon encoding the same amino acid, a conservative amino acid, or a non-conservative amino acid. Alternatively, it is performed to join together nucleic acid segments of desired functions to generate a desired combination of functions. This artificial combination is often accomplished by either chemical synthesis means, or by the artificial manipulation of isolated segments of nucleic acids, e.g., by genetic engineering techniques. When a recombinant polynucleotide encodes a polypeptide, the sequence of the encoded polypeptide can be naturally occurring ("wild type") or can be a variant (e.g., a mutant) of the naturally occurring sequence. An example of such a case is a DNA (a recombinant) encoding a wild-type protein where the DNA sequence is codon optimized for expression of the protein in a cell (e.g., a eukaryotic cell) in which the protein is not naturally found (e.g., expression of a CRISPR/Cas endonuclease, e.g., in a eukaryotic cell). A codon-optimized DNA can therefore be recombinant and non-naturally occurring while the protein encoded by the DNA may have a wild type amino acid sequence.

Thus, the term "recombinant" polypeptide does not necessarily refer to a polypeptide whose amino acid sequence does not naturally occur. Instead, a "recombinant" polypeptide is encoded by a recombinant non-naturally occurring DNA sequence, but the amino acid sequence of the polypeptide can be naturally occurring ("wild type") or non-naturally occurring (e.g., a variant, a mutant, etc.). Thus, a "recombinant" polypeptide is the result of human intervention, but may have a naturally occurring amino acid sequence.

A "vector" or "expression vector" is a replicon, such as plasmid, phage, virus, or cosmid, to which another DNA segment, i.e. an "insert", may be attached so as to bring about the replication of the attached segment in a cell.

An "expression cassette" comprises a DNA coding sequence operably linked to a promoter. "Operably linked" refers to a juxtaposition wherein the components so described are in a relationship permitting them to function in their intended manner. For instance, a promoter is operably linked to a coding sequence (or the coding sequence can also be said to be operably linked to the promoter) if the promoter affects its transcription or expression.

The terms "recombinant expression vector," or "DNA construct" are used interchangeably herein to refer to a DNA molecule comprising a vector and one insert. Recombinant expression vectors are usually generated for the purpose of expressing and/or propagating the insert(s), or for the construction of other recombinant nucleotide sequences. The insert(s) may or may not be operably linked to a promoter sequence and may or may not be operably linked to DNA regulatory sequences.

A cell has been "genetically modified" or "transformed" or "transfected" by exogenous DNA, e.g. a recombinant expression vector, when such DNA has been introduced inside the cell. The presence of the exogenous DNA results in permanent or transient genetic change. The transforming DNA may or may not be integrated (covalently linked) into the genome of the cell. In prokaryotes, yeast, and mammalian cells for example, the transforming DNA may be maintained on an episomal element such as a plasmid. With respect to eukaryotic cells, a stably transformed cell is one in which the transforming DNA has become integrated into a chromosome so that it is inherited by daughter cells through chromosome replication. This stability is demonstrated by the ability of the eukaryotic cell to establish cell lines or clones that comprise a population of daughter cells containing the transforming DNA. A "clone" is a population of cells derived from a single cell or common ancestor by mitosis. A "cell line" is a clone of a primary cell that is capable of stable growth in vitro for many generations.

Suitable methods of genetic modification (also referred to as "transformation") include e.g., viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et., al Adv Drug Deliv Rev. 2012 Sep. 13. pii: S0169-409X(12)00283-9. doi: 10.1016/j.addr.2012.09.023), and the like.

The choice of method of genetic modification is generally dependent on the type of cell being transformed and the circumstances under which the transformation is taking place (e.g., in vitro, ex vivo, or in vivo). A general discussion of these methods can be found in Ausubel, et al., Short Protocols in Molecular Biology, 3rd ed., Wiley & Sons, 1995.

A "target nucleic acid" as used herein is a polynucleotide (e.g., DNA such as genomic DNA) that includes a site ("target site" or "target sequence") targeted by a genome editing endonuclease. When the genome editing endonuclease is a CRISPR/Cas endonuclease, the target sequence is the sequence to which the guide sequence of a subject CRISPR/Cas guide RNA (e.g., a Cas9 guide RNA) will hybridize. For example, the target site (or target sequence) 5'-GAGCAUAUC-3' within a target nucleic acid is targeted by (or is bound by, or hybridizes with, or is complementary to) the sequence 5'-GAUAUGCUC-3'. Suitable hybridization conditions include physiological conditions normally present in a cell. For a double stranded target nucleic acid, the strand of the target nucleic acid that is complementary to and hybridizes with the guide RNA is referred to as the "complementary strand" or "target strand"; while the strand of the target nucleic acid that is complementary to the "target strand" (and is therefore not complementary to the guide RNA) is referred to as the "non-target strand" or "non-complementary strand".

By "cleavage" it is meant the breakage of the covalent backbone of a target nucleic acid molecule (e.g., RNA, DNA). Cleavage can be initiated by a variety of methods including, but not limited to, enzymatic or chemical hydrolysis of a phosphodiester bond. Both single-stranded cleavage and double-stranded cleavage are possible, and double-stranded cleavage can occur as a result of two distinct single-stranded cleavage events. In some embodiments, a complex comprising a CRISPR/Cas protein (e.g., a Cas9 protein) and a corresponding guide RNA is used for targeted cleavage of a double stranded DNA (dsDNA), e.g., induction of a double-stranded DNA break (DSB).

"Nuclease" and "endonuclease" are used interchangeably herein to mean an enzyme which possesses catalytic activity for nucleic acid cleavage (e.g., ribonuclease activity (ribonucleic acid cleavage), deoxyribonuclease activity (deoxyribonucleic acid cleavage), etc.). A "genome editing endonuclease" is an endonuclease that can be used for the editing of a cell's genome (e.g., by cleaving at a targeted location within the cell's genomic DNA). Examples of genome editing endonucleases include but are not limited to class 2 CRISPR/Cas endonucleases such as: (a) type II CRISPR/Cas proteins, e.g., a Cas9 protein; (b) type V CRISPR/Cas proteins, e.g., a Cpf1 protein, a C2c1 protein, a C2c3 protein, and the like; and (c) type VI CRISPR/Cas proteins, e.g., a C2c2 protein.

By "cleavage domain" or "active domain" or "nuclease domain" of a nuclease it is meant the polypeptide sequence or domain within the nuclease which possesses the catalytic activity for nucleic acid cleavage. A cleavage domain can be contained in a single polypeptide chain or cleavage activity can result from the association of two (or more) polypeptides. A single nuclease domain may consist of more than one isolated stretch of amino acids within a given polypeptide.

A "host cell" or "target cell" as used herein, denotes an in vivo or in vitro eukaryotic cell, a prokaryotic cell (e.g., bacterial or archaeal cell), or a cell from a multicellular organism (e.g., a cell line) cultured as a unicellular entity, which eukaryotic or prokaryotic cells can be, or have been, used as recipients for a subject genome targeting composition, and include the progeny of the original cell (e.g., when the cell has been transformed by the nucleic acid, or when the cells genome has been modified by the genome targeting composition). It is understood that the progeny of a single cell may not necessarily be completely identical in morphology or in genomic or total DNA complement as the original parent, due to natural, accidental, or deliberate mutation. A "recombinant host cell" (also referred to as a "genetically modified host cell") is a host cell into which has been introduced a subject genome targeting composition, e.g., which can include a nucleic acid, e.g., an expression vector. For example, a subject bacterial host cell can be a genetically modified bacterial host cell by virtue of introduction into a suitable bacterial host cell of an exogenous nucleic acid (e.g., a plasmid or recombinant expression vector) and a subject eukaryotic host cell can be a genetically modified eukaryotic host cell (e.g., a mammalian germ cell), by virtue of introduction into a suitable eukaryotic host cell of an exogenous nucleic acid.

The term "stem cell" is used herein to refer to a cell (e.g., plant stem cell, vertebrate stem cell) that has the ability both to self-renew and to generate a differentiated cell type (see Morrison et al. (1997) Cell 88:287-298). In the context of cell ontogeny, the adjective "differentiated", or "differentiating" is a relative term. A "differentiated cell" is a cell that has progressed further down the developmental pathway than the cell it is being compared with. Thus, pluripotent stem cells (described below) can differentiate into lineage-restricted progenitor cells (e.g., mesodermal stem cells), which in turn can differentiate into cells that are further restricted (e.g., neuron progenitors), which can differentiate into end-stage cells (i.e., terminally differentiated cells, e.g., neurons, cardiomyocytes, etc.), which play a characteristic role in a certain tissue type, and may or may not retain the capacity to proliferate further. Stem cells may be characterized by both the presence of specific markers (e.g., proteins, RNAs, etc.) and the absence of specific markers. Stem cells may also be identified by functional assays both in vitro and in vivo, particularly assays relating to the ability of stem cells to give rise to multiple differentiated progeny.

Stem cells of interest include pluripotent stem cells (PSCs). The term "pluripotent stem cell" or "PSC" is used herein to mean a stem cell capable of producing all cell types of the organism. Therefore, a PSC can give rise to cells of all germ layers of the organism (e.g., the endoderm, mesoderm, and ectoderm of a vertebrate). Pluripotent cells are capable of forming teratomas and of contributing to ectoderm, mesoderm, or endoderm tissues in a living organism. Pluripotent stem cells of plants are capable of giving rise to all cell types of the plant (e.g., cells of the root, stem, leaves, etc.).

PSCs of animals can be derived in a number of different ways. For example, embryonic stem cells (ESCs) are derived from the inner cell mass of an embryo (Thomson et. al, Science. 1998 Nov. 6; 282(5391):1145-7) whereas induced pluripotent stem cells (iPSCs) are derived from somatic cells (Takahashi et. al, Cell. 2007 Nov. 30; 131(5): 861-72; Takahashi et. al, Nat Protoc. 2007; 2(12):3081-9; Yu et. al, Science. 2007 Dec. 21; 318(5858):1917-20. Epub 2007 Nov. 20). Because the term PSC refers to pluripotent stem cells regardless of their derivation, the term PSC encompasses the terms ESC and iPSC, as well as the term embryonic germ stem cells (EGSC), which are another example of a PSC. PSCs may be in the form of an established cell line, they may be obtained directly from primary embryonic tissue, or they may be derived from a somatic cell. PSCs can be target cells of the methods described herein.

By "embryonic stem cell" (ESC) is meant a PSC that was isolated from an embryo, typically from the inner cell mass of the blastocyst. ESC lines are listed in the NIH Human Embryonic Stem Cell Registry, e.g. hESBGN-01, hESBGN-02, hESBGN-03, hESBGN-04 (BresaGen, Inc.); HES-1, HES-2, HES-3, HES-4, HES-5, HES-6 (ES Cell International); Miz-hES1 (MizMedi Hospital-Seoul National University); HSF-1, HSF-6 (University of California at San Francisco); and H1, H7, H9, H13, H14 (Wisconsin Alumni Research Foundation (WiCell Research Institute)). Stem cells of interest also include embryonic stem cells from other primates, such as Rhesus stem cells and marmoset stem cells. The stem cells may be obtained from any mammalian species, e.g. human, equine, bovine, porcine, canine, feline, rodent, e.g. mice, rats, hamster, primate, etc. (Thomson et al. (1998) Science 282:1145; Thomson et al. (1995) Proc. Natl. Acad. Sci USA 92:7844; Thomson et al. (1996) Biol. Reprod. 55:254; Shamblott et al., Proc. Natl. Acad. Sci. USA 95:13726, 1998). In culture, ESCs typically grow as flat colonies with large nucleo-cytoplasmic ratios, defined borders and prominent nucleoli. In addition, ESCs express SSEA-3, SSEA-4, TRA-1-60, TRA-1-81, and Alkaline Phosphatase, but not SSEA-1. Examples of methods of generating and characterizing ESCs may be found in, for example, U.S. Pat. Nos. 7,029,913, 5,843,780, and 6,200,806, the disclosures of which are incorporated herein by reference. Methods for proliferating hESCs in the undifferentiated form are described in WO 99/20741, WO 01/51616, and WO 03/020920.

By "embryonic germ stem cell" (EGSC) or "embryonic germ cell" or "EG cell" is meant a PSC that is derived from germ cells and/or germ cell progenitors, e.g. primordial germ cells, i.e. those that would become sperm and eggs. Embryonic germ cells (EG cells) are thought to have properties similar to embryonic stem cells as described above. Examples of methods of generating and characterizing EG cells may be found in, for example, U.S. Pat. No. 7,153,684; Matsui, Y., et al., (1992) Cell 70:841; Shamblott, M., et al. (2001) Proc. Natl. Acad. Sci. USA 98: 113; Shamblott, M., et al. (1998) Proc. Natl. Acad. Sci. USA, 95:13726; and Koshimizu, U., et al. (1996) Development, 122:1235, the disclosures of which are incorporated herein by reference.

By "induced pluripotent stem cell" or "iPSC" it is meant a PSC that is derived from a cell that is not a PSC (i.e., from a cell this is differentiated relative to a PSC). iPSCs can be derived from multiple different cell types, including terminally differentiated cells. iPSCs have an ES cell-like morphology, growing as flat colonies with large nucleo-cytoplasmic ratios, defined borders and prominent nuclei. In addition, iPSCs express one or more key pluripotency markers known by one of ordinary skill in the art, including but not limited to Alkaline Phosphatase, SSEA3, SSEA4, Sox2, Oct3/4, Nanog, TRA160, TRA181, TDGF 1, Dnmt3b, FoxD3, GDF3, Cyp26a1, TERT, and zfp42. Examples of methods of generating and characterizing iPSCs may be found in, for example, U.S. Patent Publication Nos. US20090047263, US20090068742, US20090191159, US20090227032, US20090246875, and US20090304646, the disclosures of which are incorporated herein by reference. Generally, to generate iPSCs, somatic cells are provided with reprogramming factors (e.g. Oct4, SOX2, KLF4, MYC, Nanog, Lin28, etc.) known in the art to reprogram the somatic cells to become pluripotent stem cells.

By "somatic cell" it is meant any cell in an organism that, in the absence of experimental manipulation, does not ordinarily give rise to all types of cells in an organism. In other words, somatic cells are cells that have differentiated sufficiently that they will not naturally generate cells of all three germ layers of the body, i.e. ectoderm, mesoderm and endoderm. For example, somatic cells would include both neurons and neural progenitors, the latter of which may be able to naturally give rise to all or some cell types of the central nervous system but cannot give rise to cells of the mesoderm or endoderm lineages.

By "mitotic cell" it is meant a cell undergoing mitosis. Mitosis is the process by which a eukaryotic cell separates the chromosomes in its nucleus into two identical sets in two separate nuclei. It is generally followed immediately by cytokinesis, which divides the nuclei, cytoplasm, organelles and cell membrane into two cells containing roughly equal shares of these cellular components.

By "post-mitotic cell" it is meant a cell that has exited from mitosis, i.e., it is "quiescent", i.e. it is no longer undergoing divisions. This quiescent state may be temporary, i.e. reversible, or it may be permanent.

By "meiotic cell" it is meant a cell that is undergoing meiosis. Meiosis is the process by which a cell divides its nuclear material for the purpose of producing gametes or spores. Unlike mitosis, in meiosis, the chromosomes undergo a recombination step which shuffles genetic material between chromosomes. Additionally, the outcome of meiosis is four (genetically unique) haploid cells, as compared with the two (genetically identical) diploid cells produced from mitosis.

The terms "treatment", "treating" and the like are used herein to generally mean obtaining a desired pharmacologic and/or physiologic effect. The effect may be prophylactic in terms of completely or partially preventing a disease or symptom thereof and/or may be therapeutic in terms of a partial or complete cure for a disease and/or adverse effect attributable to the disease. "Treatment" as used herein covers any treatment of a disease or symptom in a mammal, and includes: (a) preventing the disease or symptom from occurring in a subject which may be predisposed to acquiring the disease or symptom but has not yet been diagnosed as having it; (b) inhibiting the disease or symptom, i.e., arresting its development; or (c) relieving the disease, i.e., causing regression of the disease. The therapeutic agent may be administered before, during or after the onset of disease or injury. The treatment of ongoing disease, where the treatment stabilizes or reduces the undesirable clinical symptoms of the patient, is of particular interest. Such treatment is desirably performed prior to complete loss of function in the affected tissues. The subject therapy will desirably be administered during the symptomatic stage of the disease, and in some cases after the symptomatic stage of the disease.

The terms "individual," "subject," "host," and "patient," are used interchangeably herein and refer to any mammalian subject for whom diagnosis, treatment, or therapy is desired, e.g., humans.

In some instances, a component (e.g., a nucleic acid component (e.g., a CRISPR/Cas guide RNA); a protein component (e.g., genome editing endonuclease such as a Cas9 protein); and the like) includes a label moiety. The terms "label", "detectable label", or "label moiety" as used herein refer to any moiety that provides for signal detection and may vary widely depending on the particular nature of the assay. Label moieties of interest include both directly detectable labels (direct labels)(e.g., a fluorescent label) and indirectly detectable labels (indirect labels)(e.g., a binding pair member). A fluorescent label can be any fluorescent label (e.g., a fluorescent dye (e.g., fluorescein, Texas red, rhodamine, ALEXAFLUOR® labels, and the like), a fluorescent protein (e.g., green fluorescent protein (GFP), enhanced GFP (EGFP), yellow fluorescent protein (YFP), red fluorescent protein (RFP), cyan fluorescent protein (CFP), cherry, tomato, tangerine, and any fluorescent derivative thereof), etc.). Suitable detectable (directly or indirectly) label moieties for use in the methods include any moiety that is detectable by spectroscopic, photochemical, biochemical, immunochemical, electrical, optical, chemical, or other means. For example, suitable indirect labels include biotin (a binding pair member), which can be bound by streptavidin (which can itself be directly or indirectly labeled). Labels can also include: a radiolabel (a direct label)(e.g., $^3$H, $^{125}$I, $^{35}$S, or $^{32}$P); an enzyme (an indirect label)(e.g., peroxidase, alkaline phosphatase, galactosidase, luciferase, glucose oxidase, and the like); a fluorescent protein (a direct label)(e.g., green fluorescent protein, red fluorescent protein, yellow fluorescent protein, and any convenient derivatives thereof); a metal label (a direct label); a colorimetric label; a binding pair member; and the like. By "partner of a binding pair" or "binding pair member" is meant one of a first and a second moiety, wherein the first and the second moiety have a specific binding affinity for each other. Suitable binding pairs include, but are not limited to: antigen/antibodies (for example, digoxigenin/anti-digoxigenin, dinitrophenyl (DNP)/anti-DNP, dansyl-X-anti-dansyl, fluorescein/anti-fluorescein, lucifer yellow/anti-lucifer yellow, and rhodamine anti-rhodamine), biotin/avidin (or biotin/streptavidin) and calmodulin binding protein (CBP)/calmodulin. Any binding pair member can be suitable for use as an indirectly detectable label moiety.

Any given component, or combination of components can be unlabeled, or can be detectably labeled with a label moiety. In some cases, when two or more components are labeled, they can be labeled with label moieties that are distinguishable from one another.

General methods in molecular and cellular biochemistry can be found in such standard textbooks as Molecular Cloning: A Laboratory Manual, 3rd Ed. (Sambrook et al., HaRBor Laboratory Press 2001); Short Protocols in Molecular Biology, 4th Ed. (Ausubel et al. eds., John Wiley & Sons 1999); Protein Methods (Bollag et al., John Wiley & Sons 1996); Nonviral Vectors for Gene Therapy (Wagner et al. eds., Academic Press 1999); Viral Vectors (Kaplift & Loewy eds., Academic Press 1995); Immunology Methods Manual (I. Lefkovits ed., Academic Press 1997); and Cell and Tissue Culture: Laboratory Procedures in Biotechnology (Doyle & Griffiths, John Wiley & Sons 1998), the disclosures of which are incorporated herein by reference.

Before the present invention is further described, it is to be understood that this invention is not limited to particular embodiments described, as such may, of course, vary. It is also to be understood that the terminology used herein is for the purpose of describing particular embodiments only, and is not intended to be limiting, since the scope of the present invention will be limited only by the appended claims.

Where a range of values is provided, it is understood that each intervening value, to the tenth of the unit of the lower limit unless the context clearly dictates otherwise, between the upper and lower limit of that range and any other stated or intervening value in that stated range, is encompassed within the invention. The upper and lower limits of these smaller ranges may independently be included in the smaller ranges, and are also encompassed within the invention, subject to any specifically excluded limit in the stated range. Where the stated range includes one or both of the limits, ranges excluding either or both of those included limits are also included in the invention.

Unless defined otherwise, all technical and scientific terms used herein have the same meaning as commonly understood by one of ordinary skill in the art to which this invention belongs. Although any methods and materials similar or equivalent to those described herein can also be used in the practice or testing of the present invention, the preferred methods and materials are now described. All publications mentioned herein are incorporated herein by reference to disclose and describe the methods and/or materials in connection with which the publications are cited.

It must be noted that as used herein and in the appended claims, the singular forms "a," "an," and "the" include plural referents unless the context clearly dictates otherwise. Thus, for example, reference to "a ribonucleoprotein complex" includes a plurality of such complexes and reference to "the mutant dystrophin gene" includes reference to one or more mutant dystrophin genes and equivalents thereof known to those skilled in the art, and so forth. It is further noted that the claims may be drafted to exclude any optional element. As such, this statement is intended to serve as antecedent basis for use of such exclusive terminology as "solely," "only" and the like in connection with the recitation of claim elements, or use of a "negative" limitation.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the invention are specifically embraced by the present invention and are disclosed herein just as if each and every combination was individually and explicitly disclosed. In addition, all sub-combinations of the various embodiments and elements thereof are also specifically embraced by the present invention and are disclosed herein just as if each and every such sub-combination was individually and explicitly disclosed herein.

The publications discussed herein are provided solely for their disclosure prior to the filing date of the present application. Nothing herein is to be construed as an admission that the present invention is not entitled to antedate such publication by virtue of prior invention. Further, the dates of publication provided may be different from the actual publication dates which may need to be independently confirmed.

DETAILED DESCRIPTION

The present disclosure provides a method of modifying a mutant dystrophin gene in the genome of a cell. The present disclosure further provides compositions and kits for modifying a mutant dystrophin gene in the genome of a cell.
Compositions, Kits, and Methods Provided is a method that includes modifying a mutant dystrophin gene in the genome of a cell (e.g., a human cell). In some cases, the method includes introducing into the cell: (a) a class 2 CRISPR/Cas endonuclease (e.g., a Cas9 protein), or a nucleic acid comprising a nucleotide sequence encoding the class 2 CRISPR/Cas endonuclease; and (b) first and second CRISPR/Cas guide RNAs corresponding to the class 2 CRISPR/Cas endonuclease, or one or more nucleic acids comprising nucleotide sequences encoding the first and second CRISPR/Cas guide RNAs. The first CRISPR/Cas guide RNA comprises a guide sequence that hybridizes to a target sequence within intron 44 of the mutant dystrophin gene, and the second CRISPR/Cas guide RNA comprises a guide sequence that hybridizes to a target sequence within intron 55 of the mutant dystrophin gene. The step of introducing results in deletion of a greater than 330-kilobase region of the mutant dystrophin gene comprising exons 45-55 (e.g., in some cases due to non-homologous end-joining (NHEJ)).

Thus, in some cases, the subject methods result in cleavage of the cell's genome in introns 44 and 55 of the mutant dystrophin gene and deletion of a greater than 330-kilobase region of the mutant dystrophin gene comprising exons 45-55. The subject methods thus results in deletion of a greater than 330-kilobase region of the mutant dystrophin gene, where the deleted region comprises exons 45-55 (e.g., such that the remaining sequence encode a dystrophin mRNA missing exons 45-55, e.g., remaining sequence of intron 44 and remaining sequence of intron 55 become a single intron, and exon 44 is therefore spliced directly to exon 56). Thus, in some cases, the deleted region includes intron sequence and the remaining sequence also includes intron sequence.

In some cases, the subject methods result in a genomic deletion of greater than 330 kilobases (kb). In some cases, the subject methods result in a genomic deletion of 400 kilobases (kb) or more (e.g., 450 kb or more, 500 kb or more, 550 kb or more, 600 kb or more, 650 kb or more, 700 kb or more, etc.). For example, in some cases, the target sequence within intron 44 and the target sequence within intron 55 are separated from each other by greater than 330 kilobases (kb). In some cases, the target sequence within intron 44 and the target sequence within intron 55 are separated from each other by 400 kb or more (e.g., 450 kb or more, 500 kb or more, 550 kb or more, 600 kb or more, 650 kb or more, 700 kb or more, etc.). In some cases, the target sequence within intron 44 and the target sequence within intron 55 are separated from each other by 700 kb or more.

Thus, in some cases, the guide sequence of the first CRISPR/Cas guide RNA (e.g., a Cas9 guide RNA) has 100% complementarity over 20 contiguous nucleotides with a target sequence corresponding to intron 44 of the human dystrophin gene (e.g., a target sequence within intron 44 of the human dystrophin gene, a target sequence within a mouse dystrophin gene, etc.), and the guide sequence of the second CRISPR/Cas guide RNA (e.g., a Cas9 guide RNA) has 100% complementarity over 20 contiguous nucleotides with a target sequence corresponding to intron 55 of the human dystrophin gene (e.g., a target sequence within intron 55 of the human dystrophin gene, a target sequence within a mouse dystrophin gene, etc.). In some such cases, the target sequence corresponding to intron 44 and the target sequence corresponding to intron 55 are separated from each other by greater than 330 kilobases (kb). In some cases, the target sequence corresponding to intron 44 and the target sequence corresponding to intron 55 are separated from each other by 400 kilobases (kb) or more (e.g., 450 kb or more, 500 kb or more, 550 kb or more, 600 kb or more, 650 kb or more, 700 kb or more, etc.). In some cases, the target sequence within intron 44 and the target sequence within intron 55 are separated from each other by 700 kb or more.

Examples guide RNAs (e.g., guide sequences of guide RNAs) and target sequences that can be used to accomplish such genomic deletions in human cells are provided in Table 2 (provided in FIG. 23) and Table 9 (provided in FIG. 24).

For the subject compositions, kits, and methods the components (e.g., (a) a class 2 CRISPR/Cas endonuclease, e.g., Cas9, Cpf1, etc.; and/or (b) first and second corresponding guide RNAs, e.g., Cas9 guide RNAs, a Cpf1 guide RNAs, etc.) can be delivered to a cell (introduced into a cell) as DNA, RNA, or protein. For example, when a subject composition, kit, and/or method includes a class 2 CRISPR/Cas endonuclease (e.g., Cas9, Cpf1, etc.) and corresponding guide RNAs (e.g., Cas9 guide RNAs, Cpf1 guide RNAs, etc.), the endonuclease and guide RNAs can be delivered (introduced into the cell) as an RNP complex (i.e., a pre-assembled complexes of the CRISPR/Cas endonuclease and the corresponding CRISPR/Cas guide RNAs). Thus, a class 2 CRISPR/Cas endonuclease (e.g., Cas9) can be introduced into a cell as a protein. A class 2 CRISPR/Cas endonuclease (e.g., Cas9) can also be introduced into a cell as a nucleic acid (DNA and/or RNA) encoding the endonuclease. A CRISPR/Cas guide RNA can be introduced into a cell as RNA, or as DNA encoding the guide RNA.

In some cases, a class 2 CRISPR/Cas endonuclease (e.g., a Cas9 protein) is a fusion protein that is fused to a heterologous polypeptide (also referred to as a "fusion partner"). In some cases, a class 2 CRISPR/Cas endonuclease is fused to an amino acid sequence (a fusion partner) that provides for subcellular localization, i.e., the fusion partner is a subcellular localization sequence (e.g., one or more nuclear localization signals (NLSs) for targeting to the nucleus, two or more NLSs, three or more NLSs, etc.). In some embodiments, a class 2 CRISPR/Cas endonuclease is fused to an amino acid sequence (a fusion partner) that provides a tag (i.e., the fusion partner is a detectable label) for ease of tracking and/or purification (e.g., a fluorescent protein, e.g., green fluorescent protein (GFP), YFP, RFP, CFP, mCherry, tdTomato, and the like; a histidine tag, e.g., a 6×His tag; a hemagglutinin (HA) tag; a FLAG tag; a Myc tag; and the like). In some embodiments, the fusion partner can provide for increased or decreased stability (i.e., the fusion partner can be a stability control peptide, e.g., a degron, which in some cases is controllable (e.g., a temperature sensitive or drug controllable degron sequence).

In some cases, a class 2 CRISPR/Cas endonuclease is conjugated (e.g., fused) to a polypeptide permeant domain to promote uptake by the cell (i.e., the fusion partner promotes uptake by a cell). A number of permeant domains are known in the art and may be used, including peptides, peptidomimetics, and non-peptide carriers. For example, a permeant peptide may be derived from the third alpha helix of Drosophila melanogaster transcription factor Antennapaedia, referred to as penetratin, which comprises the amino acid sequence RQIKIWFQNRRMKWKK (SEQ ID NO: 1080). As another example, the permeant peptide can comprise the HIV-1 tat basic region amino acid sequence, which may include, for example, amino acids 49-57 of naturally-occurring tat protein. Other permeant domains include polyarginine motifs, for example, the region of amino acids 34-56 of HIV-1 rev protein, nona-arginine, octa-arginine, and the like. (See, for example, Futaki et al. (2003) Curr Protein Pept Sci. 2003 April; 4(2): 87-9 and 446; and Wender et al. (2000) Proc. Natl. Acad. Sci. U.S.A 2000 Nov. 21; 97(24):13003-8; published U.S. Patent applications 20030220334; 20030083256; 20030032593; and 20030022831; herein specifically incorporated by reference for the teachings of translocation peptides and peptoids). The nona-arginine (R9) sequence is one of the more efficient PTDs that have been characterized (Wender et al. 2000; Uemura et al. 2002). The site at which the fusion is made may be selected in order to optimize the biological activity, secretion or binding characteristics of the polypeptide. The optimal site can be determined by routine experimentation.

In some cases, a class 2 CRISPR/Cas endonuclease includes a "Protein Transduction Domain" or PTD (also known as a CPP—cell penetrating peptide), which refers to a polypeptide, polynucleotide, carbohydrate, or organic or inorganic compound that facilitates traversing a lipid bilayer, micelle, cell membrane, organelle membrane, or vesicle membrane. A PTD attached to another molecule, which can range from a small polar molecule to a large macromolecule and/or a nanoparticle, facilitates the molecule traversing a membrane, for example going from extracellular space to intracellular space, or cytosol to within an organelle. In some embodiments, a PTD is covalently linked to the amino terminus a polypeptide (e.g., a class 2 CRISPR/ Cas endonuclease, e.g., a Cas9 protein). In some embodiments, a PTD is covalently linked to the carboxyl terminus of a polypeptide (e.g., a class 2 CRISPR/Cas endonuclease, e.g., a Cas9 protein). In some cases, the PTD is inserted internally in the class 2 CRISPR/Cas endonuclease (e.g., Cas9 protein) (i.e., is not at the N- or C-terminus of the class 2 CRISPR/Cas endonuclease). In some cases, a subject class 2 CRISPR/Cas endonuclease (e.g., Cas9 protein) includes (is conjugated to, is fused to) one or more PTDs (e.g., two or more, three or more, four or more PTDs). In some cases a PTD includes a nuclear localization signal (NLS) (e.g, in some cases 2 or more, 3 or more, 4 or more, or 5 or more NLSs).

In some cases, a class 2 CRISPR/Cas endonuclease (e.g., Cas9 protein) includes one or more NLSs (e.g., 2 or more, 3 or more, 4 or more, or 5 or more NLSs). In some embodiments, a PTD is covalently linked to a nucleic acid (e.g., a CRISPR/Cas guide RNA, a polynucleotide encoding a CRISPR/Cas guide RNA, a polynucleotide encoding a class 2 CRISPR/Cas endonuclease such as a Cas9 protein or a type V or type VI CRISPR/Cas protein, etc.). Examples of PTDs include but are not limited to a minimal undecapeptide protein transduction domain (corresponding to residues 47-57 of HIV-1 TAT comprising YGRKKRRQRRR; SEQ ID NO:1076); a polyarginine sequence comprising a number of arginines sufficient to direct entry into a cell (e.g., 3, 4, 5, 6, 7, 8, 9, 10, or 10-50 arginines); a VP22 domain (Zender et al. (2002) Cancer Gene Ther. 9(6):489-96); an Drosophila Antennapedia protein transduction domain (Noguchi et al. (2003) Diabetes 52(7):1732-1737); a truncated human calcitonin peptide (Trehin et al. (2004) Pharm. Research 21:1248-1256); polylysine (Wender et al. (2000) Proc. Natl. Acad. Sci. USA 97:13003-13008); RRQRRTSKLMKR (SEQ ID NO:1077); Transportan GWTLNSAGYLLG-KINLKALAALAKKIL (SEQ ID NO:1078); KALAWEAKLAKALAKALAKHLAKALAKALKCEA (SEQ ID NO:1079); and RQIKIWFQNRRMKWKK (SEQ ID NO:1080). Exemplary PTDs include but are not limited to, YGRKKRRQRRR (SEQ ID NO:1081), RKKRRQRRR (SEQ ID NO:1082); an arginine homopolymer of from 3 arginine residues to 50 arginine residues; Exemplary PTD domain amino acid sequences include, but are not limited to, any of the following: YGRKKRRQRRR (SEQ ID NO:1083); RKKRRQRR (SEQ ID NO:1084); YARAAAR-QARA (SEQ ID NO:1085); THRLPRRRRRR (SEQ ID NO:1086); and GGRRARRRRRR (SEQ ID NO:1087). In some embodiments, the PTD is an activatable CPP (ACPP) (Aguilera et al. (2009) Integr Biol (Camb) June; 1(5-6): 371-381). ACPPs comprise a polycationic CPP (e.g., Arg9 or "R9") connected via a cleavable linker to a matching polyanion (e.g., Glu9 or "E9"), which reduces the net charge to nearly zero and thereby inhibits adhesion and uptake into cells. Upon cleavage of the linker, the polyanion is released, locally unmasking the polyarginine and its inherent adhesiveness, thus "activating" the ACPP to traverse the membrane.

A class 2 CRISPR/Cas endonuclease (e.g., Cas9 protein) can have multiple (1 or more, 2 or more, 3 or more, etc.) fusion partners in any combination of the above. As an illustrative example, a class 2 CRISPR/Cas endonuclease (e.g., Cas9 protein) can have a fusion partner that provides for tagging (e.g., GFP), and can also have a subcellular localization sequence (e.g., one or more NLSs). In some cases, such a fusion protein might also have a tag for ease of tracking and/or purification (e.g., a histidine tag, e.g., a 6×His tag; a hemagglutinin (HA) tag; a FLAG tag; a Myc tag; and the like). As another illustrative example, class 2 CRISPR/Cas endonuclease (e.g., Cas9 protein) can have one or more NLSs (e.g., two or more, three or more, four or more, five or more, 1, 2, 3, 4, or 5 NLSs). In some cases a fusion partner (or multiple fusion partners, e.g., 1, 2, 3, 4, or 5 NLSs) (e.g., an NLS, a tag, a fusion partner providing an activity, etc.) is located at or near the C-terminus of the class 2 CRISPR/Cas endonuclease (e.g., Cas9 protein). In some cases a fusion partner (or multiple fusion partners, e.g., 1, 2, 3, 4, or 5 NLSs) (e.g., an NLS, a tag, a fusion partner providing an activity, etc.) is located at the N-terminus of the class 2 CRISPR/Cas endonuclease (e.g., Cas9 protein). In some cases the class 2 CRISPR/Cas endonuclease (e.g., Cas9 protein) has a fusion partner (or multiple fusion partners, e.g., 1, 2, 3, 4, or 5 NLSs)(e.g., an NLS, a tag, a fusion partner providing an activity, etc.) at both the N-terminus and C-terminus.

Class 2 CRISPR/Cas Endonucleases

RNA-mediated adaptive immune systems in bacteria and archaea rely on Clustered Regularly Interspaced Short Palindromic Repeat (CRISPR) genomic loci and CRISPR-associated (Cas) proteins that function together to provide protection from invading viruses and plasmids. In some embodiments, a subject method, composition, and/or kit includes a class 2 CRISPR/Cas endonuclease. In class 2 CRISPR systems, the functions of the effector complex (e.g., the cleavage of target DNA) are carried out by a single endonuclease (e.g., see Zetsche et al., Cell. 2015 Oct. 22; 163(3):759-71; Makarova et al., Nat Rev Microbiol. 2015 November; 13(11):722-36; and Shmakov et al., Mol Cell. 2015 Nov. 5; 60(3):385-97). As such, the term "class 2 CRISPR/Cas protein" is used herein to encompass the endonuclease (the target nucleic acid cleaving protein) from class 2 CRISPR systems. Thus, the term "class 2 CRISPR/Cas endonuclease" as used herein encompasses type II CRISPR/Cas proteins (e.g., Cas9), type V CRISPR/Cas proteins (e.g., Cpf1, C2c1, C2C3), and type VI CRISPR/Cas proteins (e.g., C2c2). To date, class 2 CRISPR/Cas proteins encompass type II, type V, and type VI CRISPR/Cas proteins, but the term is also meant to encompass any class 2 CRISPR/Cas protein suitable for binding to a corresponding guide RNA and forming an RNP complex (e.g., and cleaving target DNA).

Type II CRISPR/Cas Endonucleases (e.g., Cas 9)

In natural Type II CRISPR/Cas systems, Cas9 functions as an RNA-guided endonuclease that uses a dual-guide RNA having a crRNA and trans-activating crRNA (tracrRNA) for target recognition and cleavage by a mechanism involving two nuclease active sites in Cas9 that together generate double-stranded DNA breaks (DSBs), or can individually generate single-stranded DNA breaks (SSBs). The Type II CRISPR endonuclease Cas9 and engineered dual-(dgRNA) or single guide RNA (sgRNA) form a ribonucleoprotein (RNP) complex that can be targeted to a desired DNA sequence. Guided by a dual-RNA complex or a chimeric single-guide RNA, Cas9 generates site-specific DSBs or SSBs within double-stranded DNA (dsDNA) target nucleic acids, which are repaired either by non-homologous end joining (NHEJ) or homology-directed recombination (HDR).

In some cases, a subject method, composition, and/or kit includes a type II CRISPR/Cas endonuclease. A type II CRISPR/Cas endonuclease is a type of class 2 CRISPR/Cas endonuclease. In some cases, the type II CRISPR/Cas endonuclease is a Cas9 protein. A Cas9 protein forms a complex with a Cas9 guide RNA. The guide RNA provides target specificity to a Cas9-guide RNA complex by having a nucleotide sequence (a guide sequence) that is complementary to a sequence (the target site) of a target nucleic acid (as described elsewhere herein). The Cas9 protein of the complex provides the site-specific activity. In other words, the Cas9 protein is guided to a target site (e.g., stabilized at a target site) within a target nucleic acid sequence (e.g. genomic DNA) by virtue of its association with the protein-binding segment of the Cas9 guide RNA.

In some cases, the CRIPR/Cas endonuclease (e.g., Cas9 protein) is a naturally-occurring protein (e.g., naturally occurs in bacterial and/or archaeal cells). In other cases, the CRIPR/Cas endonuclease (e.g., Cas9 protein) is not a naturally-occurring polypeptide (e.g., the CRIPR/Cas endonuclease is a variant CRIPR/Cas endonuclease, a chimeric protein, and the like, e.g., in some cases the CRIPR/Cas endonuclease includes one or more NLSs).

Examples of suitable Cas9 proteins include, but are not limited to, those set forth in SEQ ID NOs: 5-816. Naturally occurring Cas9 proteins bind a Cas9 guide RNA, are thereby directed to a specific sequence within a target nucleic acid (a target site), and cleave the target nucleic acid (e.g., cleave dsDNA to generate a double strand break). A chimeric Cas9 protein is a fusion protein comprising a Cas9 polypeptide that is fused to a heterologous protein (referred to as a fusion partner), where the heterologous protein provides an activity (e.g., one that is not provided by the Cas9 protein). The fusion partner can provide an activity, e.g., enzymatic activity (e.g., nuclease activity, activity for DNA and/or RNA methylation, activity for DNA and/or RNA cleavage, activity for histone acetylation, activity for histone methylation, activity for RNA modification, activity for RNA-binding, activity for RNA splicing etc.). In some cases a portion of the Cas9 protein (e.g., the RuvC domain and/or the HNH domain) exhibits reduced nuclease activity relative to the corresponding portion of a wild type Cas9 protein (e.g., in some cases the Cas9 protein is a nickase). In some cases, the Cas9 protein is enzymatically inactive, or has reduced enzymatic activity relative to a wild-type Cas9 protein (e.g., relative to *Streptococcus pyogenes* Cas9).

Assays to determine whether given protein interacts with a Cas9 guide RNA can be any convenient binding assay that tests for binding between a protein and a nucleic acid. Suitable binding assays (e.g., gel shift assays) will be known to one of ordinary skill in the art (e.g., assays that include adding a Cas9 guide RNA and a protein to a target nucleic acid).

Assays to determine whether a protein has an activity (e.g., to determine if the protein has nuclease activity that cleaves a target nucleic acid and/or some heterologous activity) can be any convenient assay (e.g., any convenient nucleic acid cleavage assay that tests for nucleic acid cleavage). Suitable assays (e.g., cleavage assays) will be known to one of ordinary skill in the art and can include adding a Cas9 guide RNA and a protein to a target nucleic acid.

In some cases, a chimeric Cas9 protein includes a heterologous polypeptide that has enzymatic activity that modifies target nucleic acid (e.g., nuclease activity, methyltransferase activity, demethylase activity, DNA repair activity, DNA damage activity, deamination activity, dismutase activity, alkylation activity, depurination activity, oxidation activity, pyrimidine dimer forming activity, integrase activity, transposase activity, recombinase activity, polymerase activity, ligase activity, helicase activity, photolyase activity or glycosylase activity).

In some cases, a chimeric Cas9 protein includes a heterologous polypeptide that has enzymatic activity that modifies a polypeptide (e.g., a histone) associated with target nucleic acid (e.g., methyltransferase activity, demethylase activity, acetyltransferase activity, deacetylase activity, kinase activity, phosphatase activity, ubiquitin ligase activity, deubiquitinating activity, adenylation activity, deadenylation activity, SUMOylating activity, deSUMOylating activity, ribosylation activity, deribosylation activity, myristoylation activity or demyristoylation activity).

In some cases, a CRISPR/Cas endonuclease (e.g., a Cas9 protein) includes a heterologous polypeptide that provides for localization within the cell. For example, in some cases, a subject CRISPR/Cas endonuclease (e.g., a Cas9 protein) includes one or more (e.g., 2 or more, 3 or more, 4 or more, 5 or more, etc.) nuclear localization sequences (NLSs). The one or more (e.g., 2 or more, 3 or more, 4 or more, 5 or more, etc.) NLSs can be at any convenient position within the CRISPR/Cas endonuclease (e.g., a Cas9 protein), e.g., N-terminus, C-terminus, internal, etc. In some cases, a CRISPR/Cas endonuclease (e.g., a Cas9 protein) includes one or more (e.g., 2 or more, 3 or more, 4 or more, 5 or more, etc.) NLSs at the N-terminus and one or more (e.g., 2 or more, 3 or more, 4 or more, 5 or more, etc.) NLSs at the C-terminus.

Many Cas9 orthologs from a wide variety of species have been identified and in some cases the proteins share only a few identical amino acids. Identified Cas9 orthologs have similar domain architecture with a central HNH endonuclease domain and a split RuvC/RNaseH domain (e.g., RuvCI, RuvCII, and RuvCIII) (e.g., see Table 1). For example, a Cas9 protein can have 3 different regions (sometimes referred to as RuvC-I, RuvC-II, and RucC-III), that are not contiguous with respect to the primary amino acid sequence of the Cas9 protein, but fold together to form a RuvC domain once the protein is produced and folds. Thus, Cas9 proteins can be said to share at least 4 key motifs with a conserved architecture. Motifs 1, 2, and 4 are RuvC like motifs while motif 3 is an HNH-motif. The motifs set forth in Table 1 may not represent the entire RuvC-like and/or HNH domains as accepted in the art, but Table 1 does present motifs that can be used to help determine whether a given protein is a Cas9 protein.

TABLE 1

Table 1 lists 4 motifs that are present in Cas9 sequences from various species. The amino acids listed in Table 1 are from the Cas9 from S. pyogenes (SEQ ID NO: 5).

| Motif # | Motif | Amino acids (residue #s) | Highly conserved |
|---|---|---|---|
| 1 | RuvC-like I | IGLDIGTNSVGWAVI (7-21) (SEQ ID NO: 1) | D10, G12, G17 |
| 2 | RuvC-like II | IVIEMARE (759-766) (SEQ ID NO: 2) | E762 |
| 3 | HNH-motif | DVDHIVPQSFLKDDSIDNKVLTRSDKN (837-863) (SEQ ID NO: 3) | H840, N854, N863 |
| 4 | RuvC-like III | HHAHDAYL (982-989) (SEQ ID NO: 4) | H982, H983, A984, D986, A987 |

In some cases, a suitable Cas9 protein comprises an amino acid sequence having 4 motifs, each of motifs 1-4 having 60% or more, 70% or more, 75% or more, 80% or more, 85% or more, 90% or more, 95% or more, 99% or more or 100% amino acid sequence identity to motifs 1-4 as set forth in SEQ ID NOs: 1-4, respectively (e.g., see Table 1), or to the corresponding portions in any of the amino acid sequences set forth in SEQ ID NOs: 5-816.

In other words, in some cases, a suitable Cas9 polypeptide comprises an amino acid sequence having 4 motifs, each of motifs 1-4 having 60% or more, 70% or more, 75% or more, 80% or more, 85% or more, 90% or more, 95% or more, 99% or more or 100% amino acid sequence identity to motifs 1-4 of the Cas9 amino acid sequence set forth in SEQ ID NO: 5 (e.g., the sequences set forth in SEQ ID NOs: 1-4, e.g., see Table 1), or to the corresponding portions in any of the amino acid sequences set forth in SEQ ID NOs: 6-816.

In some cases, a suitable Cas9 protein comprises an amino acid sequence having 4 motifs, each of motifs 1-4 having 60% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 70% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 75% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 80% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 85% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 90% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 95% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 99% or more amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. In some cases, a suitable Cas9 protein comprises an amino acid sequence having 4 motifs, each of motifs 1-4 having 100% amino acid sequence identity to motifs 1-4 of the Cas9 amino acid sequence set forth as SEQ ID NO: 5 (the motifs are in Table 1, and are set forth as SEQ ID NOs: 1-4, respectively), or to the corresponding portions in any of the amino acid sequences set forth in SEQ ID NOs: 6-816. Any Cas9 protein as defined above can be used as a Cas9 polypeptide, as part of a chimeric Cas9 polypeptide (e.g., a Cas9 fusion protein), any of which can be used in an RNP of the present disclosure.

In some cases, a suitable Cas9 protein comprises an amino acid sequence having 60% or more, 70% or more, 75% or more, 80% or more, 85% or more, 90% or more, 95% or more, 99% or more or 100% amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816.

In some cases, a suitable Cas9 protein comprises an amino acid sequence having 60% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 70% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 75% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 80% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 85% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 90% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 95% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 99% or more amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. In some cases, a suitable Cas9 protein comprises an amino acid sequence having 100% amino acid sequence identity to amino acids 7-166 or 731-1003 of the Cas9 amino acid sequence set forth in SEQ ID NO: 5, or to the corresponding portions in any of the amino acid sequences set forth as SEQ ID NOs: 6-816. Any Cas9 protein as defined above can be used as a Cas9 polypeptide, as part of a chimeric Cas9 polypeptide (e.g., a Cas9 fusion protein), any of which can be used in an RNP of the present disclosure.

In some cases, a suitable Cas9 protein comprises an amino acid sequence having 60% or more, 70% or more, 75% or more, 80% or more, 85% or more, 90% or more, 95% or more, 99% or more or 100% amino acid sequence identity to the Cas9 amino acid sequence set forth in SEQ ID NO: 5, or to any of the amino acid sequences set forth as SEQ ID NOs: 6-816.

In some cases, a suitable Cas9 protein comprises an amino acid sequence having 60% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 70% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 75% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 80% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 85% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 90% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 95% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 99% or more amino acid sequence identity to the Cas9 amino acid sequence set forth in SEQ ID NO: 5, or to any of the amino acid sequences set forth as SEQ ID NOs: 6-816. In some cases, a suitable Cas9 protein comprises an amino acid sequence having 100% amino acid sequence identity to the Cas9 amino acid sequence set forth in SEQ ID NO: 5, or to any of the amino acid sequences set forth as SEQ ID NOs: 6-816. Any Cas9 protein as defined above can be used as a Cas9 polypeptide, as part of a chimeric Cas9 polypeptide (e.g., a Cas9 fusion protein), any of which can be used in an RNP of the present disclosure.

In some cases, a Cas9 protein comprises 4 motifs (as listed in Table 1), at least one with (or each with) amino acid sequences having 75% or more, 80% or more, 85% or more, 90% or more, 95% or more, 99% or more or 100% amino acid sequence identity to each of the 4 motifs listed in Table 1 (SEQ ID NOs:1-4), or to the corresponding portions in any of the amino acid sequences set forth as SEQ ID NOs: 6-816.

In some cases, a Cas9 protein is a high fidelity Cas9 protein (e.g., see Kleinstiver et al., Nature. 2016 Jan. 28; 529(7587):490-5).

In some cases, a suitable Cas9 protein is a Cas9 protein as described in Slaymaker et al. (2016) *Science* 351:84. For example, a suitable Cas9 protein includes a *Streptococcus pyogenes* Cas9 with substitutions of one or more of K810, K848, K855, K1003, and R1060 (where the amino acid numbering is based on the numbering set out in SEQ ID NO:5). For example, a suitable Cas9 protein includes a *Streptococcus pyogenes* Cas9 with K810A, K1003A, and R1060A substitutions (where the amino acid numbering is based on the numbering set out in SEQ ID NO:5). As another example, a suitable Cas9 protein includes a *Streptococcus pyogenes* Cas9 with K848A, K1003A, and R1060A substitutions (where the amino acid numbering is based on the numbering set out in SEQ ID NO:5). As another example, a suitable Cas9 protein includes a *Streptococcus pyogenes* Cas9 with a K855A substitution (where the amino acid numbering is based on the numbering set out in SEQ ID NO:5).

Type V and Type VI CRISPR/Cas Endonucleases

In some cases, a subject method, composition, and/or kit includes a type V or type VI CRISPR/Cas endonuclease (e.g., Cpf1, C2c1, C2c2, C2c3). Type V and type VI CRISPR/Cas endonucleases are a type of class 2 CRISPR/Cas endonuclease. Examples of type V CRISPR/Cas endonucleases include but are not limited to: Cpf1, C2c1, and C2c3. An example of a type VI CRISPR/Cas endonuclease is C2c2. In some cases a subject method, composition, and/or kit includes a type V CRISPR/Cas endonuclease (e.g., Cpf1, C2c1, C2c3). In some cases, a Type V CRISPR/Cas endonuclease is a Cpf1 protein. In some cases, a subject method, composition, and/or kit includes a type VI CRISPR/Cas endonuclease (e.g., C2c2).

Like type II CRISPR/Cas endonucleases, type V and VI CRISPR/Cas endonucleases form a complex with a corresponding guide RNA. The guide RNA provides target specificity to an endonuclease-guide RNA RNP complex by having a nucleotide sequence (a guide sequence) that is complementary to a sequence (the target site) of a target nucleic acid (as described elsewhere herein). The endonuclease of the complex provides the site-specific activity. In other words, the endonuclease is guided to a target site (e.g., stabilized at a target site) within a target nucleic acid sequence (e.g. genomic DNA) by virtue of its association with the protein-binding segment of the guide RNA.

Examples and guidance related to type V and type VI CRISPR/Cas proteins (e.g., cpf1, C2c1, C2c2, and C2c3 guide RNAs) can be found in the art, for example, see Zetsche et al, Cell. 2015 Oct. 22; 163(3):759-71; Makarova et al, Nat Rev Microbiol. 2015 November; 13(11):722-36; and Shmakov et al., Mol Cell. 2015 Nov. 5; 60(3):385-97.

In some cases, the Type V or type VI CRISPR/Cas endonuclease (e.g., Cpf1, C2c1, C2c2, C2c3) is enzymatically active, e.g., the Type V or type VI CRISPR/Cas polypeptide, when bound to a guide RNA, cleaves a target nucleic acid. In some cases, the Type V or type VI CRISPR/Cas endonuclease (e.g., Cpf1, C2c1, C2c2, C2c3) exhibits reduced enzymatic activity relative to a corresponding wild-type a Type V or type VI CRISPR/Cas endonuclease (e.g., Cpf1, C2c1, C2c2, C2c3), and retains DNA binding activity (e.g., in some cases the endonuclease is a nickase).

In some cases a type V CRISPR/Cas endonuclease is a Cpf1 protein. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 1088-1092. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to a contiguous stretch of from 100 amino acids to 200 amino acids (aa), from 200 aa to 400 aa, from 400 aa to 600 aa, from 600 aa to 800 aa, from 800 aa to 1000 aa, from 1000 aa to 1100 aa, from 1100 aa to 1200 aa, or from 1200 aa to 1300 aa, of the Cpf1 amino acid sequence set forth in any of SEQ ID NOs: 1088-1092.

In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI domain of the Cpf1 amino acid sequence set forth in any of SEQ ID NOs: 1088-1092. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCII domain of the Cpf1 amino acid sequence set forth in any of SEQ ID NOs: 1088-1092. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCIII domain of the Cpf1 amino acid sequence set forth in any of SEQ ID NOs: 1088-1092. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI, RuvCII, and RuvCIII domains of the Cpf1 amino acid sequence set forth in any of SEQ ID NOs: 1088-1092.

In some cases, the Cpf1 protein exhibits reduced enzymatic activity relative to a wild-type Cpf1 protein (e.g., relative to a Cpf1 protein comprising the amino acid sequence set forth in any of SEQ ID NOs: 1088-1092), and retains DNA binding activity. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 1088-1092; and comprises an amino acid substitution (e.g., a D→A substitution) at an amino acid residue corresponding to amino acid 917 of the Cpf1 amino acid sequence set forth in SEQ ID NO: 1088. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 1088-1092; and comprises an amino acid substitution (e.g., an E→A substitution) at an amino acid residue corresponding to amino acid 1006 of the Cpf1 amino acid sequence set forth in SEQ ID NO: 1088. In some cases, a Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs:

1088-1092; and comprises an amino acid substitution (e.g., a D→A substitution) at an amino acid residue corresponding to amino acid 1255 of the Cpf1 amino acid sequence set forth in SEQ ID NO: 1088.

In some cases, a suitable Cpf1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the Cpf1 amino acid sequence set forth in any of SEQ ID NOs: 1088-1092.

In some cases a type V CRISPR/Cas endonuclease is a C2c1 protein (examples include those set forth as SEQ ID NOs: 1112-1119). In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c1 amino acid sequence set forth in any of SEQ ID NOs: 1112-1119. In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to a contiguous stretch of from 100 amino acids to 200 amino acids (aa), from 200 aa to 400 aa, from 400 aa to 600 aa, from 600 aa to 800 aa, from 800 aa to 1000 aa, from 1000 aa to 1100 aa, from 1100 aa to 1200 aa, or from 1200 aa to 1300 aa, of the C2c1 amino acid sequence set forth in any of SEQ ID NOs: 1112-1119.

In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI domain of the C2c1 amino acid sequences set forth in any of SEQ ID NOs: 1112-1119). In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCII domain of the C2c1 amino acid sequence set forth in any of SEQ ID NOs: 1112-1119. In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCIII domain of the C2c1 amino acid sequence set forth in any of SEQ ID NOs: 1112-1119. In some cases, a C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI, RuvCII, and RuvCIII domains of the C2c1 amino acid sequence set forth in any of SEQ ID NOs: 1112-1119.

In some cases, the C2c1 protein exhibits reduced enzymatic activity relative to a wild-type C2c1 protein (e.g., relative to a C2c1 protein comprising the amino acid sequence set forth in any of SEQ ID NOs: 1112-1119), and retains DNA binding activity. In some cases, a suitable C2c1 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c1 amino acid sequence set forth in any of SEQ ID NOs: 1112-1119.

In some cases a type V CRISPR/Cas endonuclease is a C2c3 protein (examples include those set forth as SEQ ID NOs: 1120-1123). In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c3 amino acid sequence set forth in any of SEQ ID NOs: 1120-1123. In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to a contiguous stretch of from 100 amino acids to 200 amino acids (aa), from 200 aa to 400 aa, from 400 aa to 600 aa, from 600 aa to 800 aa, from 800 aa to 1000 aa, from 1000 aa to 1100 aa, from 1100 aa to 1200 aa, or from 1200 aa to 1300 aa, of the C2c3 amino acid sequence set forth in any of SEQ ID NOs: 1120-1123.

In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI domain of the C2c3 amino acid sequence set forth in any of SEQ ID NOs: 1120-1123. In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCII domain of the C2c3 amino acid sequence set forth in any of SEQ ID NOs: 1120-1123. In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCIII domain of the C2c3 amino acid sequence set forth in any of SEQ ID NOs: 1120-1123. In some cases, a C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI, RuvCII, and RuvCIII domains of the C2c3 amino acid sequence set forth in any of SEQ ID NOs: 1120-1123.

In some cases, the C2c3 protein exhibits reduced enzymatic activity relative to a wild-type C2c3 protein (e.g., relative to a C2c3 protein comprising the amino acid sequence set forth in any of SEQ ID NOs: 1120-1123), and retains DNA binding activity. In some cases, a suitable C2c3 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c3 amino acid sequence set forth in any of SEQ ID NOs: 1120-1123.

In some cases a type VI CRISPR/Cas endonuclease is a C2c2 protein (examples include those set forth as SEQ ID NOs: 1124-1135). In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c2 amino acid sequence set forth in any of SEQ ID NOs: 1124-1135. In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to a contiguous stretch of from 100 amino acids to 200 amino acids (aa), from 200 aa to 400 aa, from 400 aa to 600 aa, from 600 aa to 800 aa, from 800 aa to 1000 aa, from 1000 aa to 1100 aa, from 1100 aa to 1200 aa, or from 1200 aa to 1300 aa, of the C2c2 amino acid sequence set forth in any of SEQ ID NOs: 1124-1135.

In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI domain of the C2c2 amino acid sequence set forth in any of SEQ ID NOs: 1124-1135. In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCII domain of the C2c2 amino acid sequence set forth in any of SEQ ID NOs: 1124-1135. In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCIII domain of the C2c2 amino acid sequence set forth in any of SEQ ID NOs: 1124-1135. In some cases, a C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the RuvCI, RuvCII, and RuvCIII domains of the C2c2 amino acid sequence set forth in any of SEQ ID NOs: 1124-1135.

In some cases, the C2c2 protein exhibits reduced enzymatic activity relative to a wild-type C2c2 protein (e.g., relative to a C2c2 protein comprising the amino acid sequence set forth in any of SEQ ID NOs: 1124-1135), and retains DNA binding activity. In some cases, a suitable C2c2 protein comprises an amino acid sequence having at least 30%, at least 35%, at least 40%, at least 45%, at least 50%, at least 55%, at least 60%, at least 65%, at least 70%, at least 75%, at least 80%, at least 85%, at least 90%, at least 95%, at least 90%, or 100%, amino acid sequence identity to the C2c2 amino acid sequence set forth in any of SEQ ID NOs: 1124-1135.

PAM Sequence

A wild type class 2 CRISPR/Cas endonuclease (e.g., Cas9 protein) normally has nuclease activity that cleaves a target nucleic acid (e.g., a double stranded DNA (dsDNA)) at a target site defined by complementarity between the guide sequence of the CRISPR/Cas guide RNA and the target nucleic acid. In some cases, site-specific cleavage of the target nucleic acid occurs at locations determined by both (i) base-pairing complementarity between the CRISPR/Cas guide RNA and the target nucleic acid; and (ii) a short motif referred to as the protospacer adjacent motif (PAM) in the target nucleic acid. For example, when the class 2 CRISPR/Cas endonuclease is a wild type Cas9 protein, the PAM sequence that is recognized (e.g., bound) by the Cas9 protein is present on the non-complementary strand (the strand that does not hybridize with the guide sequence of the Cas9 guide RNA) of the target DNA and is adjacent to the target site.

In some cases, (e.g., in some cases where the class 2 CRISPR/Cas endonuclease is an *S. pyogenes* Cas9 protein) the PAM sequence of the non-complementary strand is 5'-XGG-3', where X is any DNA nucleotide and X is immediately 3' of the target sequence of the non-complementary strand of the target DNA. As such, the sequence of the complementary strand that hybridizes with the PAM sequence is 5'-CCY-3', where Y is any DNA nucleotide and Y is immediately 5' of the target sequence of the complementary strand of the target DNA. In some such embodiments, X and Y can be complementary and the X-Y base pair can be any basepair (e.g., X=C and Y=G; X=G and Y=C; X=A and Y=T, X=T and Y=A).

In some cases, it may be advantageous to use different class 2 CRISPR/Cas endonucleases (e.g., Cas9 proteins from various species, type V or type VI CRISPR/Cas endonucleases, and the like) for the subject methods in order to capitalize on various characteristics (e.g., enzymatic characteristics) of the different endonucleases (e.g., for different PAM sequence preferences; for increased or decreased enzymatic activity; for an increased or decreased level of cellular toxicity; to change the balance between NHEJ, homology-directed repair, single strand breaks, double strand breaks, etc.).

Class 2 CRISPR/Cas endonucleases (e.g., Cas9 proteins) from various species can require different PAM sequences in the target DNA, and different types of Class 2 CRISPR/Cas endonucleases (e.g., type II proteins, e.g., Cas9 proteins; type V proteins; type VI proteins; and the like) can have different requirements (e.g., 5', 3', complementary strand, non-complementary strand, distance from target sequence, and the like) for the location of the PAM sequence relative to the targeted sequence of the target DNA. Thus, for a particular Class 2 CRISPR/Cas endonuclease of choice, the PAM sequence requirement may be different than the 5'-XGG-3' sequence described above for the *S. pyogenes* Cas9 protein.

In some embodiments (e.g., when the Cas9 protein is derived from *S. pyogenes* or a closely related Cas9 is used; see for example, Chylinski et al., RNA Biol. 2013 May; 10(5):726-37; and Jinek et al., Science. 2012 Aug. 17; 337(6096):816-21; both of which are hereby incorporated by reference in their entirety), a PAM sequence can be can be 5'-NGG-3', where N is any nucleotide. In some embodiments (e.g., when a Cas9 protein is derived from the Cas9 protein of *Neisseria meningitidis* or a closely related Cas9 is used), the PAM sequence can be 5'-NNNNGANN-3', 5'-NNNNGTTN-3', 5'-NNNNGNNT-3', 5'-NNNNGTNN-3', 5'-NNNNGNTN-3', or 5'-NNNNGATT-3', where N is any nucleotide. In some embodiments (e.g., when a Cas9 protein is derived from *Streptococcus thermophilus* #1 or a closely related Cas9 is used), the PAM sequence can be 5'-NNA-GAA-3', 5'-NNAGGA-3', 5'-NNGGAA-3', 5'-NNANAA-3', or 5'-NNGGGA-3' where N is any nucleotide. In some embodiments (e.g., when a Cas9 protein is derived from

*Treponema denticola* (TD) or a closely related Cas9 is used), the PAM sequence can be 5'-NAAAAN-3', 5'-NAAAAC-3', 5'-NAAANC-3', 5'-NANAAC-3', or 5'-NNAAAC-3', where N is any nucleotide.

The PAM requirements for any given Class 2 CRISPR/Cas endonuclease can be determined using standard, routine, conventional methods, which can include experimental methods and/or in silico analysis of naturally existing sequences from species of interest. For example, as would be known by one of ordinary skill in the art, additional PAM sequences for other Class 2 CRISPR/Cas endonucleases (e.g., Cas9 proteins of different species; type IV CRISPR/Cas endonucleases, type V CRISPR/Cas endonucleases, and the like) can readily be determined using bioinformatic analysis (e.g., analysis of genomic sequencing data). For example, see Mojica et al., Microbiology. 2009 March; 155(Pt 3):733-40; and Esvelt et al., Nat Methods. 2013 November; 10(11):1116-21, for additional information.

In addition, as known in the art, the PAM-interacting domain of a Class 2 CRISPR/Cas endonuclease (e.g., a Cas9 protein) can be derived from an endonuclease (e.g., Cas9 protein) from a first species, and the PAM sequence can correspond to that domain Thus, in some cases, a Class 2 CRISPR/Cas endonuclease has a PAM-interacting domain that is derived from (e.g., that is from) a Class 2 CRISPR/Cas endonuclease (e.g., Cas9 protein) of a first species, and other portions of the Class 2 CRISPR/Cas endonuclease (e.g., Cas9 protein) can be derived from (e.g., can be from) a second species.

Guide RNA (for CRISPR/Cas Endonucleases)

A nucleic acid molecule that binds to a class 2 CRISPR/Cas endonuclease (e.g., a Cas9 protein; a type V or type VI CRISPR/Cas protein; a Cpf1 protein; etc.) and targets the complex to a specific location within a target nucleic acid is referred to herein as a "guide RNA" or "CRISPR/Cas guide nucleic acid" or "CRISPR/Cas guide RNA."

A guide RNA provides target specificity to the complex (the RNP complex) by including a targeting segment, which includes a guide sequence (also referred to herein as a targeting sequence), which is a nucleotide sequence that is complementary to a sequence of a target nucleic acid.

A guide RNA can be referred to by the protein to which it corresponds. For example, when the class 2 CRISPR/Cas endonuclease is a Cas9 protein, the corresponding guide RNA can be referred to as a "Cas9 guide RNA." Likewise, as another example, when the class 2 CRISPR/Cas endonuclease is a Cpf1 protein, the corresponding guide RNA can be referred to as a "Cpf1 guide RNA."

In some embodiments, a guide RNA includes two separate nucleic acid molecules: an "activator" and a "targeter" and is referred to herein as a "dual guide RNA", a "double-molecule guide RNA", a "two-molecule guide RNA", or a "dgRNA." In some embodiments, the guide RNA is one molecule (e.g., for some class 2 CRISPR/Cas proteins, the corresponding guide RNA is a single molecule; and in some cases, an activator and targeter are covalently linked to one another, e.g., via intervening nucleotides), and the guide RNA is referred to as a "single guide RNA", a "single-molecule guide RNA," a "one-molecule guide RNA", or simply "sgRNA."

In some embodiments a subject CRISPR/Cas guide RNA (e.g., a Cas9 guide RNA) targets a target sequence depicted in Table 2 (provided in FIG. 23) (e.g., also see Table 3 of the examples below). In some embodiments a subject CRISPR/Cas guide RNA (e.g., a Cas9 guide RNA) targets a target sequence depicted in Table 9 (provided in FIG. 24).

Table 2 (FIG. 23). Examples of (i) target sequences (non-complementary strand) of target DNA, and (ii) guide sequences of CRISPR/Cas guide RNAs (e.g., for CRISPR/Cas proteins such as *S. pyogenes* Cas9 that have a PAM requirement of NGG in the non-complementary strand), where the first targeted sequence is within intron 44 of the human dystrophin gene and the second targeted sequence is within intron 55 of the human dystrophin gene. A guide sequence that is targeted to a target sequence within intron 44 of the human dystrophin gene is referred to as a "44" series guide sequence; and a guide sequence that is targeted to a target sequence within intron 55 of the human dystrophin gene is referred to as a "55" series guide sequence.

For example, in some cases, the non-complementary strand of target sequence that is targeted by a first CRISPR/Cas guide RNA (e.g., a Cas9 guide RNA) includes a sequence selected from SEQ ID NOs: 1140-1144 (which sequences are 20 nucleotides long and are within intron 44 of the human dystrophin gene). In some cases, the non-complementary strand of target sequence that is targeted by a first CRISPR/Cas guide RNA (e.g., a Cas9 guide RNA) includes a sequence selected from SEQ ID NOs: 1145-1149 (which sequences are 17 nucleotides long and are within intron 44 of the human dystrophin gene). In some cases, a first CRISPR/Cas guide RNA (e.g., a Cas9 guide RNA) includes a guide sequence that includes a sequence selected from SEQ ID NOs: 1150-1154 (which sequences are 20 nucleotides long and hybridize to a target sequence within intron 44 of the human dystrophin gene). In some cases, a first CRISPR/Cas guide RNA (e.g., a Cas9 guide RNA) includes a guide sequence that includes a sequence selected from SEQ ID NOs: 1155-1159 (which sequences are 17 nucleotides long and hybridize to a target sequence within intron 44 of the human dystrophin gene). In some cases, the non-complementary strand of target sequence that is targeted by a first CRISPR/Cas guide RNA (e.g., a Cas9 guide RNA) includes a sequence selected from SEQ ID NOs: 1136-1139 and SEQ ID NOs: 1180-1222 (which sequences are within intron 44 of the human dystrophin gene). In some cases, a first CRISPR/Cas guide RNA (e.g., a Cas9 guide RNA) includes a guide sequence that includes a sequence selected from SEQ ID NOs: 1223-1269 (which sequences hybridize to a target sequence within intron 44 of the human dystrophin gene).

In some embodiments, the non-complementary strand of target sequence that is targeted by a second CRISPR/Cas guide RNA (e.g., a Cas9 guide RNA) includes a sequence selected from SEQ ID NOs: 1160-1164 (which sequences are 20 nucleotides long and are within intron 55 of the human dystrophin gene). In some cases, the non-complementary strand of target sequence that is targeted by a second CRISPR/Cas guide RNA (e.g., a Cas9 guide RNA) includes a sequence selected from SEQ ID NOs: 1165-1169 (which sequences are 17 nucleotides long and are within intron 55 of the human dystrophin gene). In some cases, a second CRISPR/Cas guide RNA (e.g., a Cas9 guide RNA) includes a guide sequence that includes a sequence selected from SEQ ID NOs: 1170-1174 (which sequences are 20 nucleotides long and hybridize to a target sequence within intron 55 of the human dystrophin gene). In some cases, a second CRISPR/Cas guide RNA (e.g., a Cas9 guide RNA) includes a guide sequence that includes a sequence selected from SEQ ID NOs: 1175-1179 (which sequences are 17 nucleotides long and hybridize to a target sequence within intron 55 of the human dystrophin gene).). In some cases, the non-complementary strand of target sequence that is targeted by a second CRISPR/Cas guide RNA (e.g., a Cas9 guide RNA) includes a sequence selected from SEQ ID NOs: 1270-1317 (which sequences are within intron 55 of the human dystrophin gene). In some cases, a second CRISPR/Cas guide RNA (e.g., a Cas9 guide RNA) includes a guide sequence that includes a sequence selected from SEQ ID NOs: 1318-1365 (which sequences hybridize to a target sequence within intron 55 of the human dystrophin gene).

In some cases, the non-complementary strand of target sequence that is targeted by a first CRISPR/Cas guide RNA (e.g., a Cas9 guide RNA) includes a sequence selected from SEQ ID NOs: 1140-1144 (which sequences are 20 nucleotides long and are within intron 44 of the human dystrophin gene), and the non-complementary strand of target sequence that is targeted by a second CRISPR/Cas guide RNA (e.g., a Cas9 guide RNA) includes a sequence selected from SEQ ID NOs: 1160-1164 (which sequences are 20 nucleotides long and are within intron 55 of the human dystrophin gene).

In some cases, the non-complementary strand of target sequence that is targeted by a first CRISPR/Cas guide RNA (e.g., a Cas9 guide RNA) includes a sequence selected from SEQ ID NOs: 1136-1139 and SEQ ID NOs: 1180-1222 (which sequences are within intron 44 of the human dystrophin gene), and the non-complementary strand of target sequence that is targeted by a second CRISPR/Cas guide RNA (e.g., a Cas9 guide RNA) includes a sequence selected from SEQ ID NOs: 1270-1317 (which sequences are 20 nucleotides long and are within intron 55 of the human dystrophin gene).

In some cases, the non-complementary strand of target sequence that is targeted by a first CRISPR/Cas guide RNA (e.g., a Cas9 guide RNA) includes a sequence selected from SEQ ID NOs: 1145-1149 (which sequences are 17 nucleotides long and are within intron 44 of the human dystrophin gene), and the non-complementary strand of target sequence that is targeted by a second CRISPR/Cas guide RNA (e.g., a Cas9 guide RNA) includes a sequence selected from SEQ ID NOs: 1165-1169 (which sequences are 17 nucleotides long and are within intron 55 of the human dystrophin gene).

In some cases, a first CRISPR/Cas guide RNA (e.g., a Cas9 guide RNA) includes a guide sequence that includes a sequence selected from SEQ ID NOs: 1150-1154 (which sequences are 20 nucleotides long and hybridize to a target sequence within intron 44 of the human dystrophin gene), and a second CRISPR/Cas guide RNA (e.g., a Cas9 guide RNA) includes a guide sequence that includes a sequence selected from SEQ ID NOs: 1170-1174 (which sequences are 20 nucleotides long and hybridize to a target sequence within intron 55 of the human dystrophin gene).

In some cases, a first CRISPR/Cas guide RNA (e.g., a Cas9 guide RNA) includes a guide sequence that includes a sequence selected from SEQ ID NOs: 1150-1154 (which sequences are 20 nucleotides long and hybridize to a target sequence within intron 44 of the human dystrophin gene), and a second CRISPR/Cas guide RNA (e.g., a Cas9 guide RNA) includes a guide sequence that includes a sequence selected from SEQ ID NOs: 1170-1174 (which sequences are 20 nucleotides long and hybridize to a target sequence within intron 55 of the human dystrophin gene).

In some cases, a first CRISPR/Cas guide RNA (e.g., a Cas9 guide RNA) includes a guide sequence that includes a sequence selected from SEQ ID NOs: 1223-1269 (which sequences hybridize to a target sequence within intron 44 of the human dystrophin gene), and a second CRISPR/Cas guide RNA (e.g., a Cas9 guide RNA) includes a guide sequence that includes a sequence selected from SEQ ID NOs: 1318-1365 (which sequences hybridize to a target sequence within intron 55 of the human dystrophin gene). In some cases, the duplex-forming portion of a guide RNA suitable for use herein comprises the sequence:

(SEQ ID NO: 1366)
gttttagagctaGAAAtagcaagttaaaataaggctagtccgttatcaac ttgaaaaagtggcaccgagtcggtgcTTTTTT,
or (SEQ ID NO: 1367)
guuuuagagcuaGAAAuagcaaguuaaaauaaggcuaguccguuaucaac uugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1223; and a second second CRISPR/Cas guide RNA (e.g., a Cas9 guide RNA) includes a guide sequence comprising the nucleotide sequence set forth in SEQ ID NO:1320. In some cases, the duplex-forming portion of a guide RNA suitable for use herein comprises the sequence:

(SEQ ID NO: 1366)
gttttagagctaGAAAtagcaagttaaaataaggctagtccgttatcaac ttgaaaaagtggcaccgagtcggtgcTTTTTT,
or (SEQ ID NO: 1367)
guuuuagagcuaGAAAuagcaaguuaaaauaaggcuaguccguuaucaac uugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1224; and a second CRISPR/Cas guide RNA (e.g., a Cas9 guide RNA) includes a guide sequence comprising the nucleotide sequence set forth in SEQ ID NO:1320. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1225; and a second second CRISPR/Cas guide RNA (e.g., a Cas9 guide RNA) includes a guide sequence comprising the nucleotide sequence set forth in SEQ ID NO:1320. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1153; and a second second CRISPR/Cas guide RNA (e.g., a Cas9 guide RNA) includes a guide sequence comprising the nucleotide sequence set forth in SEQ ID NO:1172. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1153; and a second second CRISPR/Cas guide RNA (e.g., a Cas9 guide RNA) includes a guide sequence comprising the nucleotide sequence set forth in SEQ ID NO:1171. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1152; and a second second CRISPR/Cas guide RNA (e.g., a Cas9 guide RNA) includes a guide sequence comprising the nucleotide sequence set forth in SEQ ID NO:1172. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1152; and a second second CRISPR/Cas guide RNA (e.g., a Cas9 guide RNA) includes a guide sequence comprising the nucleotide sequence set forth in SEQ ID NO:1171. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1150; and a second second CRISPR/Cas guide RNA (e.g., a Cas9 guide RNA) includes a guide sequence comprising the nucleotide sequence set forth in SEQ ID NO:1172. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1150; and a second second CRISPR/Cas guide RNA (e.g., a Cas9 guide RNA) includes a guide sequence comprising the nucleotide sequence set forth in SEQ ID NO:1171. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1150; and a second second CRISPR/Cas guide RNA (e.g., a Cas9 guide RNA) includes a guide sequence comprising the nucleotide sequence set forth in SEQ ID NO:1174. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or -continued (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence comprising the nucleotide sequence set forth in SEQ ID NO:1152; and a second second CRISPR/Cas guide RNA (e.g., a Cas9 guide RNA) includes a guide sequence comprising the nucleotide sequence set forth in SEQ ID NO:1174. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

In some cases, a first CRISPR/Cas guide RNA (e.g., a Cas9 guide RNA) includes a guide sequence that includes a sequence selected from SEQ ID NOs: 1155-1159 (which sequences are 17 nucleotides long and hybridize to a target sequence within intron 44 of the human dystrophin gene), and a second CRISPR/Cas guide RNA (e.g., a Cas9 guide RNA) includes a guide sequence that includes a sequence selected from SEQ ID NOs: 1175-1179 (which sequences are 17 nucleotides long and hybridize to a target sequence within intron 55 of the human dystrophin gene).

In some cases, the non-complementary strand of target sequence that is targeted by a first CRISPR/Cas guide RNA (e.g., a Cas9 guide RNA) includes the sequence set forth in SEQ ID NO: 1143 (within intron 44), and the non-complementary strand of target sequence that is targeted by a second CRISPR/Cas guide RNA (e.g., a Cas9 guide RNA) includes the sequence set forth in SEQ ID NO: 1162 (within intron 55). In some cases, the non-complementary strand of target sequence that is targeted by a first CRISPR/Cas guide RNA (e.g., a Cas9 guide RNA) includes the sequence set forth in SEQ ID NO: 1148 (within intron 44), and the non-complementary strand of target sequence that is targeted by a second CRISPR/Cas guide RNA (e.g., a Cas9 guide RNA) includes the sequence set forth in SEQ ID NO: 1167 (within intron 55).

In some cases, a first CRISPR/Cas guide RNA (e.g., a Cas9 guide RNA) includes a guide sequence that includes the sequence set forth in SEQ ID NO: 1153 (targets intron 44), and a second CRISPR/Cas guide RNA (e.g., a Cas9 guide RNA) includes a guide sequence that includes the sequence set forth in SEQ ID NO: 1172 (targets intron 55). In some cases, a first CRISPR/Cas guide RNA (e.g., a Cas9 guide RNA) includes a guide sequence that includes the sequence set forth in SEQ ID NO: 1158 (targets intron 44), and a second CRISPR/Cas guide RNA (e.g., a Cas9 guide RNA) includes a guide sequence that includes the sequence set forth in SEQ ID NO: 1177 (targets intron 55).

Cas9 Guide RNA

A nucleic acid molecule that binds to a Cas9 protein and targets the complex to a specific location within a target nucleic acid is referred to herein as a "Cas9 guide RNA."

A Cas9 guide RNA (can be said to include two segments, a first segment (referred to herein as a "targeting segment"); and a second segment (referred to herein as a "protein-binding segment"). By "segment" it is meant a segment/section/region of a molecule, e.g., a contiguous stretch of nucleotides in a nucleic acid molecule. A segment can also mean a region/section of a complex such that a segment may comprise regions of more than one molecule.

The first segment (targeting segment) of a Cas9 guide RNA includes a nucleotide sequence (a guide sequence) that is complementary to (and therefore hybridizes with) a specific sequence (a target site) within a target nucleic acid (e.g., a target genomic DNA). The protein-binding segment (or "protein-binding sequence") interacts with (binds to) a Cas9 polypeptide. The protein-binding segment of a subject Cas9 guide RNA includes two complementary stretches of nucleotides that hybridize to one another to form a double stranded RNA duplex (dsRNA duplex). Site-specific binding and/or cleavage of a target nucleic acid (e.g., genomic DNA) can occur at locations (e.g., target sequence of a target locus, e.g., introns 44 and 55 of the human dystrophin gene) determined by base-pairing complementarity between the Cas9 guide RNA (the guide sequence of the Cas9 guide RNA) and the target nucleic acid.

A Cas9 guide RNA and a Cas9 protein form a complex (e.g., bind via non-covalent interactions). The Cas9 guide RNA provides target specificity to the complex by including a targeting segment, which includes a guide sequence (a nucleotide sequence that is complementary to a sequence of a target nucleic acid). The Cas9 protein of the complex provides the site-specific activity (e.g., cleavage activity). In other words, the Cas9 protein is guided to a target nucleic acid sequence (e.g. genomic DNA) by virtue of its association with the Cas9 guide RNA.

The "guide sequence" also referred to as the "targeting sequence" of a Cas9 guide RNA can be modified so that the Cas9 guide RNA can target a Cas9 protein to any desired sequence of any desired target nucleic acid, with the exception that the protospacer adjacent motif (PAM) sequence can be taken into account. Thus, for example, a Cas9 guide RNA can have a targeting segment with a sequence (a guide sequence) that has complementarity with (e.g., can hybridize to) a sequence in a nucleic acid in a eukaryotic cell (e.g., genomic DNA).

In some embodiments, a Cas9 guide RNA includes two separate nucleic acid molecules: an "activator" and a "targeter" and is referred to herein as a "dual Cas9 guide RNA", a "double-molecule Cas9 guide RNA", or a "two-molecule Cas9 guide RNA" a "dual guide RNA", or a "dgRNA." In some embodiments, the activator and targeter are covalently linked to one another (e.g., via intervening nucleotides) and the guide RNA is referred to as a "single guide RNA", a "Cas9 single guide RNA", a "single-molecule Cas9 guide RNA," or a "one-molecule Cas9 guide RNA", or simply "sgRNA."

A Cas9 guide RNA comprises a crRNA-like ("CRISPR RNA"/"targeter"/"crRNA"/"crRNA repeat") molecule and a corresponding tracrRNA-like ("trans-acting CRISPR RNA"/"activator"/"tracrRNA") molecule. A crRNA-like molecule (targeter) comprises both the targeting segment (single stranded) of the Cas9 guide RNA and a stretch ("duplex-forming segment") of nucleotides that forms one half of the dsRNA duplex of the protein-binding segment of the Cas9 guide RNA. A corresponding tracrRNA-like molecule (activator/tracrRNA) comprises a stretch of nucleotides (duplex-forming segment) that forms the other half of the dsRNA duplex of the protein-binding segment of the guide nucleic acid. In other words, a stretch of nucleotides of a crRNA-like molecule are complementary to and hybridize with a stretch of nucleotides of a tracrRNA-like molecule to form the dsRNA duplex of the protein-binding domain of the Cas9 guide RNA. As such, each targeter molecule can be said to have a corresponding activator molecule (which has a region that hybridizes with the targeter). The targeter molecule additionally provides the targeting segment. Thus, a targeter and an activator molecule (as a corresponding pair) hybridize to form a Cas9 guide RNA. The exact sequence of a given crRNA or tracrRNA molecule is characteristic of the species in which the RNA molecules are found. A subject dual Cas9 guide RNA can include any corresponding activator and targeter pair.

The term "activator" or "activator RNA" is used herein to mean a tracrRNA-like molecule (tracrRNA: "trans-acting CRISPR RNA") of a Cas9 dual guide RNA (and therefore of a Cas9 single guide RNA when the "activator" and the "targeter" are linked together by, e.g., intervening nucleotides). Thus, for example, a Cas9 guide RNA (dgRNA or sgRNA) comprises an activator sequence (e.g., a tracrRNA sequence). A tracr molecule (a tracrRNA) is a naturally existing molecule that hybridizes with a CRISPR RNA molecule (a crRNA) to form a Cas9 dual guide RNA. The term "activator" is used herein to encompass naturally existing tracrRNAs, but also to encompass tracrRNAs with modifications (e.g., truncations, sequence variations, base modifications, backbone modifications, linkage modifications, etc.) where the activator retains at least one function of a tracrRNA (e.g., contributes to the dsRNA duplex to which Cas9 protein binds). In some cases the activator provides one or more stem loops that can interact with Cas9 protein. An activator can be referred to as having a tracr sequence (tracrRNA sequence) and in some cases is a tracrRNA, but the term "activator" is not limited to naturally existing tracrRNAs.

The term "targeter" or "targeter RNA" is used herein to refer to a crRNA-like molecule (crRNA: "CRISPR RNA") of a Cas9 dual guide RNA (and therefore of a Cas9 single guide RNA when the "activator" and the "targeter" are linked together, e.g., by intervening nucleotides). Thus, for example, a Cas9 guide RNA (dgRNA or sgRNA) comprises a targeting segment (which includes nucleotides that hybridize with (are complementary to) a target nucleic acid, and a duplex-forming segment (e.g., a duplex forming segment of a crRNA, which can also be referred to as a crRNA repeat). Because the sequence of a targeting segment (the segment that hybridizes with a target sequence of a target nucleic acid) of a targeter is modified by a user to hybridize with a desired target nucleic acid, the sequence of a targeter will often be a non-naturally occurring sequence. However, the duplex-forming segment of a targeter (described in more detail below), which hybridizes with the duplex-forming segment of an activator, can include a naturally existing sequence (e.g., can include the sequence of a duplex-forming segment of a naturally existing crRNA, which can also be referred to as a crRNA repeat). Thus, the term targeter is used herein to distinguish from naturally occurring crRNAs, despite the fact that part of a targeter (e.g., the duplex-forming segment) often includes a naturally occurring sequence from a crRNA. However, the term "targeter" encompasses naturally occurring crRNAs.

A Cas9 guide RNA can also be said to include 3 parts: (i) a targeting sequence (a nucleotide sequence that hybridizes with a sequence of the target nucleic acid); (ii) an activator sequence (as described above)(in some cases, referred to as a tracr sequence); and (iii) a sequence that hybridizes to at least a portion of the activator sequence to form a double stranded duplex. A targeter has (i) and (iii); while an activator has (ii).

A Cas9 guide RNA (e.g. a dual guide RNA or a single guide RNA) can be comprised of any corresponding activator and targeter pair. In some cases, the duplex forming segments can be swapped between the activator and the targeter. In other words, in some cases, the targeter includes a sequence of nucleotides from a duplex forming segment of a tracrRNA (which sequence would normally be part of an activator) while the activator includes a sequence of nucleotides from a duplex forming segment of a crRNA (which sequence would normally be part of a targeter).

As noted above, a targeter comprises both the targeting segment (single stranded) of the Cas9 guide RNA and a stretch ("duplex-forming segment") of nucleotides that forms one half of the dsRNA duplex of the protein-binding segment of the Cas9 guide RNA. A corresponding tracrRNA-like molecule (activator) comprises a stretch of nucleotides (a duplex-forming segment) that forms the other half of the dsRNA duplex of the protein-binding segment of the Cas9 guide RNA. In other words, a stretch of nucleotides of the targeter is complementary to and hybridizes with a stretch of nucleotides of the activator to form the dsRNA duplex of the protein-binding segment of a Cas9 guide RNA. As such, each targeter can be said to have a corresponding activator (which has a region that hybridizes with the targeter). The targeter molecule additionally provides the targeting segment. Thus, a targeter and an activator (as a corresponding pair) hybridize to form a Cas9 guide RNA. The particular sequence of a given naturally existing crRNA or tracrRNA molecule is characteristic of the species in which the RNA molecules are found. Examples of suitable activator and targeter are well known in the art.

A Cas9 guide RNA (e.g. a dual guide RNA or a single guide RNA) can be comprised of any corresponding activator and targeter pair. Non-limiting examples of nucleotide sequences that can be included in a Cas9 guide RNA (dgRNA or sgRNA) include sequences set forth in SEQ ID NOs: 827-1075, or complements thereof. For example, in some cases, sequences from SEQ ID NOs: 827-957 (which are from tracrRNAs) or complements thereof, can pair with sequences from SEQ ID NOs: 964-1075 (which are from crRNAs), or complements thereof, to form a dsRNA duplex of a protein binding segment. In some cases, the duplex-forming portion of a guide RNA suitable for use herein comprises the sequence:

(SEQ ID NO: 1366)
gttttagagctaGAAAtagcaagttaaaataaggctagtccgttatcaa cttgaaaaagtggcaccgagtcggtgcTTTTTT,
or (SEQ ID NO: 1367)
guuuuagagcuaGAAAuagcaaguuaaaauaaggcuaguccguuaucaa cuugaaaaaguggcaccgagucggugcUUUUUU.

Targeting Segment of a Cas9 Guide RNA

A subject guide RNA includes a guide sequence (i.e., a targeting sequence)(a nucleotide sequence that is complementary to a sequence (a target site) in a target nucleic acid). In other words, the targeting segment of a subject guide nucleic acid can interact with a target nucleic acid (e.g., double stranded DNA (dsDNA)) in a sequence-specific manner via hybridization (i.e., base pairing). As such, the nucleotide sequence of the targeting segment may vary (depending on the target) and can determine the location within the target nucleic acid that the Cas9 guide RNA and the target nucleic acid will interact. The targeting segment of a Cas9 guide RNA can be modified (e.g., by genetic engineering)/designed to hybridize to any desired sequence (target site) within a target nucleic acid (e.g., a eukaryotic target nucleic acid such as genomic DNA).

The targeting segment can have a length of 7 or more nucleotides (nt) (e.g., 8 or more, 9 or more, 10 or more, 12 or more, 15 or more, 20 or more, 25 or more, 30 or more, or 40 or more nucleotides). In some cases, the targeting segment can have a length of from 7 to 100 nucleotides (nt) (e.g., from 7 to 80 nt, from 7 to 60 nt, from 7 to 40 nt, from 7 to 30 nt, from 7 to 25 nt, from 7 to 22 nt, from 7 to 20 nt, from 7 to 18 nt, from 8 to 80 nt, from 8 to 60 nt, from 8 to 40 nt, from 8 to 30 nt, from 8 to 25 nt, from 8 to 22 nt, from 8 to 20 nt, from 8 to 18 nt, from 10 to 100 nt, from 10 to 80 nt, from 10 to 60 nt, from 10 to 40 nt, from 10 to 30 nt, from 10 to 25 nt, from 10 to 22 nt, from 10 to 20 nt, from 10 to 18 nt, from 12 to 100 nt, from 12 to 80 nt, from 12 to 60 nt, from 12 to 40 nt, from 12 to 30 nt, from 12 to 25 nt, from 12 to 22 nt, from 12 to 20 nt, from 12 to 18 nt, from 14 to 100 nt, from 14 to 80 nt, from 14 to 60 nt, from 14 to 40 nt, from 14 to 30 nt, from 14 to 25 nt, from 14 to 22 nt, from 14 to 20 nt, from 14 to 18 nt, from 16 to 100 nt, from 16 to 80 nt, from 16 to 60 nt, from 16 to 40 nt, from 16 to 30 nt, from 16 to 25 nt, from 16 to 22 nt, from 16 to 20 nt, from 16 to 18 nt, from 18 to 100 nt, from 18 to 80 nt, from 18 to 60 nt, from 18 to 40 nt, from 18 to 30 nt, from 18 to 25 nt, from 18 to 22 nt, or from 18 to 20 nt).

The nucleotide sequence (the targeting sequence, the guide sequence) of the targeting segment that is complementary to a nucleotide sequence (target site) of the target nucleic acid can have a length of 10 nt or more. For example, the targeting sequence of the targeting segment that is complementary to a target site of the target nucleic acid can have a length of 12 nt or more, 15 nt or more, 17 nt or more, 18 nt or more, 19 nt or more, or 20 nt or more. In some cases, the nucleotide sequence (the targeting sequence) of the targeting segment that is complementary to a nucleotide sequence (target site) of the target nucleic acid has a length of 12 nt or more. In some cases, the nucleotide sequence (the targeting sequence) of the targeting segment that is complementary to a nucleotide sequence (target site) of the target nucleic acid has a length of 17 nt or more. In some cases, the nucleotide sequence (the targeting sequence) of the targeting segment that is complementary to a nucleotide sequence (target site) of the target nucleic acid has a length of 18 nt or more.

For example, the targeting sequence (guide sequence) of the targeting segment that is complementary to a target sequence of the target nucleic acid can have a length of from 10 to 100 nucleotides (nt) (e.g., from 10 to 90 nt, from 10 to 75 nt, from 10 to 60 nt, from 10 to 50 nt, from 10 to 35 nt, from 10 to 30 nt, from 10 to 25 nt, from 10 to 22 nt, from 10 to 20 nt, from 12 to 100 nt, from 12 to 90 nt, from 12 to 75 nt, from 12 to 60 nt, from 12 to 50 nt, from 12 to 35 nt, from 12 to 30 nt, from 12 to 25 nt, from 12 to 22 nt, from 12 to 20 nt, from 15 to 100 nt, from 15 to 90 nt, from 15 to 75 nt, from 15 to 60 nt, from 15 to 50 nt, from 15 to 35 nt, from 15 to 30 nt, from 15 to 25 nt, from 15 to 22 nt, from 15 to 20 nt, from 17 to 100 nt, from 17 to 90 nt, from 17 to 75 nt, from 17 to 60 nt, from 17 to 50 nt, from 17 to 35 nt, from 17 to 30 nt, from 17 to 25 nt, from 17 to 22 nt, from 17 to 20 nt, from 18 to 100 nt, from 18 to 90 nt, from 18 to 75 nt, from 18 to 60 nt, from 18 to 50 nt, from 18 to 35 nt, from 18 to 30 nt, from 18 to 25 nt, from 18 to 22 nt, or from 18 to 20 nt). In some cases, the targeting sequence of the targeting segment that is complementary to a target sequence of the target nucleic acid has a length of from 15 nt to 30 nt. In some cases, the targeting sequence of the targeting segment that is complementary to a target sequence of the target nucleic acid has a length of from 15 nt to 25 nt. In some cases, the targeting sequence of the targeting segment that is complementary to a target sequence of the target nucleic acid has a length of from 17 nt to 30 nt. In some cases, the targeting sequence of the targeting segment that is complementary to a target sequence of the target nucleic acid has a length of from 17 nt to 25 nt. In some cases, the targeting sequence of the targeting segment that is complementary to a target sequence of the target nucleic acid has a length of from 17 nt to 22 nt. In some cases, the targeting sequence of the targeting segment that is complementary to a target sequence of the target nucleic acid has a length of from 18 nt to 30 nt. In some cases, the targeting sequence of the targeting segment that is complementary to a target sequence of the target nucleic acid has a length of from 18 nt to 25 nt. In some cases, the targeting sequence of the targeting segment that is complementary to a target sequence of the target nucleic acid has a length of from 18 nt to 22 nt. In some cases, the targeting sequence of the targeting segment that is complementary to a target site of the target nucleic acid is 20 nucleotides in length. In some cases, the targeting sequence of the targeting segment that is complementary to a target site of the target nucleic acid is 19 nucleotides in length. In some cases, the targeting sequence of the targeting segment that is complementary to a target site of the target nucleic acid is 18 nucleotides in length. In some cases, the targeting sequence of the targeting segment that is complementary to a target site of the target nucleic acid is 17 nucleotides in length.

The percent complementarity between the targeting sequence (guide sequence) of the targeting segment and the target site of the target nucleic acid can be 60% or more (e.g., 65% or more, 70% or more, 75% or more, 80% or more, 85% or more, 90% or more, 95% or more, 97% or more, 98% or more, 99% or more, or 100%). In some cases, the percent complementarity between the targeting sequence of the targeting segment and the target site of the target nucleic acid is 100% over the seven contiguous 5'-most nucleotides of the target site of the target nucleic acid. In some cases, the percent complementarity between the targeting sequence of the targeting segment and the target site of the target nucleic acid is 60% or more over about 20 contiguous nucleotides. In some cases, the percent complementarity between the targeting sequence of the targeting segment and the target site of the target nucleic acid is 100% over the fourteen contiguous 5'-most nucleotides of the target site of the target nucleic acid and as low as 0% or more over the remainder. In such a case, the targeting sequence can be considered to be 14 nucleotides in length. In some cases, the percent complementarity between the targeting sequence of the targeting segment and the target site of the target nucleic acid is 100% over the seven contiguous 5'-most nucleotides of the target site of the target nucleic acid and as low as 0% or more over the remainder.

In some cases, the percent complementarity between the targeting sequence of the targeting segment and the target site of the target nucleic acid is 100% over the 7 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 8 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 9 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 10 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 17 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 100% over the 18 contiguous 5'-most nucleotides of the target site of the target nucleic acid (which can be complementary to the 3'-most nucleotides of the targeting sequence of the Cas9 guide RNA). In some cases, the percent complementarity between the targeting sequence of the targeting segment and the target site of the target nucleic acid is 60% or more (e.g., e.g., 65% or more, 70% or more, 75% or more, 80% or more, 85% or more, 90% or more, 95% or more, 97% or more, 98% or more, 99% or more, or 100%) over 20 contiguous nucleotides. In some cases, the percent complementarity between the targeting sequence of the targeting segment and the target site of the target nucleic acid is 60% or more (e.g., e.g., 65% or more, 70% or more, 75% or more, 80% or more, 85% or more, 90% or more, 95% or more, 97% or more, 98% or more, 99% or more, or 100%) over 17 contiguous nucleotides.

In some cases, the percent complementarity between the targeting sequence of the targeting segment and the target site of the target nucleic acid is 100% over the 7 contiguous 5'-most nucleotides of the target site of the target nucleic acid and as low as 0% or more over the remainder. In such a case, the targeting sequence can be considered to be 7 nucleotides in length. In some cases, the percent complementarity between the targeting sequence of the targeting segment and the target site of the target nucleic acid is 100% over the 8 contiguous 5'-most nucleotides of the target site of the target nucleic acid and as low as 0% or more over the remainder. In such a case, the targeting sequence can be considered to be 8 nucleotides in length. In some cases, the percent complementarity between the targeting sequence of the targeting segment and the target site of the target nucleic acid is 100% over the 9 contiguous 5'-most nucleotides of the target site of the target nucleic acid and as low as 0% or more over the remainder. In such a case, the targeting sequence can be considered to be 9 nucleotides in length. In some cases, the percent complementarity between the targeting sequence of the targeting segment and the target site of the target nucleic acid is 100% over the 10 contiguous 5'-most nucleotides of the target site of the target nucleic acid and as low as 0% or more over the remainder. In such a case, the targeting sequence can be considered to be 10 nucleotides in length. In some cases, the percent complementarity between the targeting sequence of the targeting segment and the target site of the target nucleic acid is 100% over the 11 contiguous 5'-most nucleotides of the target site of the target nucleic acid and as low as 0% or more over the remainder. In such a case, the targeting sequence can be considered to be 11 nucleotides in length. In some cases, the percent complementarity between the targeting sequence of the targeting segment and the target site of the target nucleic acid is 100% over the 12 contiguous 5'-most nucleotides of the target site of the target nucleic acid and as low as 0% or more over the remainder. In such a case, the targeting sequence can be considered to be 12 nucleotides in length. In some cases, the percent complementarity between the targeting sequence of the targeting segment and the target site of the target nucleic acid is 100% over the 13 contiguous 5'-most nucleotides of the target site of the target nucleic acid and as low as 0% or more over the remainder. In such a case, the targeting sequence can be considered to be 13 nucleotides in length. In some cases, the percent complementarity between the targeting sequence of the targeting segment and the target site of the target nucleic acid is 100% over the 14 contiguous 5'-most nucleotides of the target site of the target nucleic acid and as low as 0% or more over the remainder. In such a case, the targeting sequence can be considered to be 14 nucleotides in length. In some cases, the percent complementarity between the targeting sequence of the targeting segment and the target site of the target nucleic acid is 100% over the 17 contiguous 5'-most nucleotides of the target site of the target nucleic acid and as low as 0% or more over the remainder. In such a case, the targeting sequence can be considered to be 17 nucleotides in length. In some cases, the percent complementarity between the targeting sequence of the targeting segment and the target site of the target nucleic acid is 100% over the 18 contiguous 5'-most nucleotides of the target site of the target nucleic acid and as low as 0% or more over the remainder. In such a case, the targeting sequence can be considered to be 18 nucleotides in length.

Examples of various Cas9 proteins and Cas9 guide RNAs (as well as information regarding requirements related to protospacer adjacent motif (PAM) sequences present in targeted nucleic acids) can be found in the art, for example, see Jinek et al., Science. 2012 Aug. 17; 337(6096):816-21; Chylinski et al., RNA Biol. 2013 May; 10(5):726-37; Ma et al., Biomed Res Int. 2013; 2013:270805; Hou et al., Proc Natl Acad Sci USA. 2013 Sep. 24; 110(39):15644-9; Jinek et al., Elife. 2013; 2:e00471; Pattanayak et al., Nat Biotechnol. 2013 September; 31(9):839-43; Qi et al, Cell. 2013 Feb. 28; 152(5):1173-83; Wang et al., Cell. 2013 May 9; 153(4): 910-8; Auer et al., Genome Res. 2013 Oct. 31; Chen et al., Nucleic Acids Res. 2013 Nov. 1; 41(20):e19; Cheng et al., Cell Res. 2013 October; 23(10):1163-71; Cho et al., Genetics. 2013 November; 195(3):1177-80; DiCarlo et al., Nucleic Acids Res. 2013 April; 41(7):4336-43; Dickinson et al., Nat Methods. 2013 October; 10(10):1028-34; Ebina et al., Sci Rep. 2013; 3:2510; Fujii et. al, Nucleic Acids Res. 2013 Nov. 1; 41(20):e187; Hu et al., Cell Res. 2013 November; 23(11):1322-5; Jiang et al., Nucleic Acids Res. 2013 Nov. 1; 41(20):e188; Larson et al., Nat Protoc. 2013 November; 8(11):2180-96; *Mali* et. at., Nat Methods. 2013 October; 10(10):957-63; Nakayama et al., Genesis. 2013 December; 51(12):835-43; Ran et al., Nat Protoc. 2013 November; 8(11):2281-308; Ran et al., Cell. 2013 Sep. 12; 154(6):1380-9; Upadhyay et al., G3 (Bethesda). 2013 Dec. 9; 3(12):2233-8; Walsh et al., Proc Natl Acad Sci USA. 2013 Sep. 24; 110(39):15514-5; Xie et al., Mol Plant. 2013 Oct. 9; Yang et al., Cell. 2013 Sep. 12; 154(6):1370-9; Briner et al., Mol Cell. 2014 Oct. 23; 56(2):333-9; and U.S. patents and patent applications: U.S. Pat. Nos. 8,906,616; 8,895,308; 8,889,418; 8,889,356; 8,871,445; 8,865,406; 8,795,965; 8,771,945; 8,697,359; 20140068797; 20140170753; 20140179006; 20140179770; 20140186843; 20140186919; 20140186958; 20140189896; 20140227787; 20140234972; 20140242664; 20140242699; 20140242700; 20140242702; 20140248702; 20140256046; 20140273037; 20140273226; 20140273230; 20140273231; 20140273232; 20140273233; 20140273234; 20140273235; 20140287938; 20140295556; 20140295557; 20140298547; 20140304853; 20140309487; 20140310828; 20140310830; 20140315985; 20140335063; 20140335620; 20140342456; 20140342457; 20140342458; 20140349400; 20140349405; 20140356867; 20140356956; 20140356958; 20140356959; 20140357523; 20140357530; 20140364333; and 20140377868; all of which are hereby incorporated by reference in their entirety. Guide RNAs corresponding to type V and type VI CRISPR/Cas endonucleases (e.g., Cpf1 Guide RNA)

A guide RNA that binds to a type V or type VI CRISPR/Cas protein (e.g., Cpf1, C2c1, C2c2, C2c3), and targets the complex to a specific location within a target nucleic acid is referred to herein generally as a "type V or type VI CRISPR/Cas guide RNA". An example of a more specific term is a "Cpf1 guide RNA."

A type V or type VI CRISPR/Cas guide RNA (e.g., cpf1 guide RNA) can have a total length of from 30 nucleotides (nt) to 200 nt, e.g., from 30 nt to 180 nt, from 30 nt to 160 nt, from 30 nt to 150 nt, from 30 nt to 125 nt, from 30 nt to 100 nt, from 30 nt to 90 nt, from 30 nt to 80 nt, from 30 nt to 70 nt, from 30 nt to 60 nt, from 30 nt to 50 nt, from 50 nt to 200 nt, from 50 nt to 180 nt, from 50 nt to 160 nt, from 50 nt to 150 nt, from 50 nt to 125 nt, from 50 nt to 100 nt, from 50 nt to 90 nt, from 50 nt to 80 nt, from 50 nt to 70 nt, from 50 nt to 60 nt, from 70 nt to 200 nt, from 70 nt to 180 nt, from 70 nt to 160 nt, from 70 nt to 150 nt, from 70 nt to 125 nt, from 70 nt to 100 nt, from 70 nt to 90 nt, or from 70 nt to 80 nt). In some cases, a type V or type VI CRISPR/Cas guide RNA (e.g., cpf1 guide RNA) has a total length of at least 30 nt (e.g., at least 40 nt, at least 50 nt, at least 60 nt, at least 70 nt, at least 80 nt, at least 90 nt, at least 100 nt, or at least 120 nt,).

In some cases, a Cpf1 guide RNA has a total length of 35 nt, 36 nt, 37 nt, 38 nt, 39 nt, 40 nt, 41 nt, 42 nt, 43 nt, 44 nt, 45 nt, 46 nt, 47 nt, 48 nt, 49 nt, or 50 nt.

Like a Cas9 guide RNA, a type V or type VI CRISPR/Cas guide RNA (e.g., cpf1 guide RNA) can include a target nucleic acid-binding segment and a duplex-forming region (e.g., in some cases formed from two duplex-forming segments, i.e., two stretches of nucleotides that hybridize to one another to form a duplex).

The target nucleic acid-binding segment of a type V or type VI CRISPR/Cas guide RNA (e.g., cpf1 guide RNA) can have a length of from 15 nt to 30 nt, e.g., 15 nt, 16 nt, 17 nt, 18 nt, 19 nt, 20 nt, 21 nt, 22 nt, 23 nt, 24 nt, 25 nt, 26 nt, 27 nt, 28 nt, 29 nt, or 30 nt. In some cases, the target nucleic acid-binding segment has a length of 23 nt. In some cases, the target nucleic acid-binding segment has a length of 24 nt. In some cases, the target nucleic acid-binding segment has a length of 25 nt.

The guide sequence of a type V or type VI CRISPR/Cas guide RNA (e.g., cpf1 guide RNA) can have a length of from 15 nt to 30 nt (e.g., 15 to 25 nt, 15 to 24 nt, 15 to 23 nt, 15 to 22 nt, 15 to 21 nt, 15 to 20 nt, 15 to 19 nt, 15 to 18 nt, 17 to 30 nt, 17 to 25 nt, 17 to 24 nt, 17 to 23 nt, 17 to 22 nt, 17 to 21 nt, 17 to 20 nt, 17 to 19 nt, 17 to 18 nt, 18 to 30 nt, 18 to 25 nt, 18 to 24 nt, 18 to 23 nt, 18 to 22 nt, 18 to 21 nt, 18 to 20 nt, 18 to 19 nt, 19 to 30 nt, 19 to 25 nt, 19 to 24 nt, 19 to 23 nt, 19 to 22 nt, 19 to 21 nt, 19 to 20 nt, 20 to 30 nt, 20 to 25 nt, 20 to 24 nt, 20 to 23 nt, 20 to 22 nt, 20 to 21 nt, 15 nt, 16 nt, 17 nt, 18 nt, 19 nt, 20 nt, 21 nt, 22 nt, 23 nt, 24 nt, 25 nt, 26 nt, 27 nt, 28 nt, 29 nt, or 30 nt). In some cases, the guide sequence has a length of 17 nt. In some cases, the guide sequence has a length of 18 nt. In some cases, the guide sequence has a length of 19 nt. In some cases, the guide sequence has a length of 20 nt. In some cases, the guide sequence has a length of 21 nt. In some cases, the guide sequence has a length of 22 nt. In some cases, the guide sequence has a length of 23 nt. In some cases, the guide sequence has a length of 24 nt.

The guide sequence of a type V or type VI CRISPR/Cas guide RNA (e.g., cpf1 guide RNA) can have 100% complementarity with a corresponding length of target nucleic acid sequence. The guide sequence can have less than 100% complementarity with a corresponding length of target nucleic acid sequence. For example, the guide sequence of a type V or type VI CRISPR/Cas guide RNA (e.g., cpf1 guide RNA) can have 1, 2, 3, 4, or 5 nucleotides that are not complementary to the target nucleic acid sequence. For example, in some cases, where a guide sequence has a length of 25 nucleotides, and the target nucleic acid sequence has a length of 25 nucleotides, in some cases, the target nucleic acid-binding segment has 100% complementarity to the target nucleic acid sequence. As another example, in some cases, where a guide sequence has a length of 25 nucleotides, and the target nucleic acid sequence has a length of 25 nucleotides, in some cases, the target nucleic acid-binding segment has 1 non-complementary nucleotide and 24 complementary nucleotides with the target nucleic acid sequence. As another example, in some cases, where a guide sequence has a length of 25 nucleotides, and the target nucleic acid sequence has a length of 25 nucleotides, in some cases, the target nucleic acid-binding segment has 2 non-complementary nucleotides and 23 complementary nucleotides with the target nucleic acid sequence.

The duplex-forming segment of a type V or type VI CRISPR/Cas guide RNA (e.g., cpf1 guide RNA) (e.g., of a targeter RNA or an activator RNA) can, in some cases, have a length of from 15 nt to 25 nt (e.g., 15 nt, 16 nt, 17 nt, 18 nt, 19 nt, 20 nt, 21 nt, 22 nt, 23 nt, 24 nt, or 25 nt).

In some cases, the RNA duplex of a type V or type VI CRISPR/Cas guide RNA (e.g., cpf1 guide RNA) can have a length of from 5 base pairs (bp) to 40 bp (e.g., from 5 to 35 bp, 5 to 30 bp, 5 to 25 bp, 5 to 20 bp, 5 to 15 bp, 5-12 bp, 5-10 bp, 5-8 bp, 6 to 40 bp, 6 to 35 bp, 6 to 30 bp, 6 to 25 bp, 6 to 20 bp, 6 to 15 bp, 6 to 12 bp, 6 to 10 bp, 6 to 8 bp, 7 to 40 bp, 7 to 35 bp, 7 to 30 bp, 7 to 25 bp, 7 to 20 bp, 7 to 15 bp, 7 to 12 bp, 7 to 10 bp, 8 to 40 bp, 8 to 35 bp, 8 to 30 bp, 8 to 25 bp, 8 to 20 bp, 8 to 15 bp, 8 to 12 bp, 8 to 10 bp, 9 to 40 bp, 9 to 35 bp, 9 to 30 bp, 9 to 25 bp, 9 to 20 bp, 9 to 15 bp, 9 to 12 bp, 9 to 10 bp, 10 to 40 bp, 10 to 35 bp, 10 to 30 bp, 10 to 25 bp, 10 to 20 bp, 10 to 15 bp, or 10 to 12 bp).

As an example, a duplex-forming segment of a Cpf1 guide RNA can comprise a nucleotide sequence selected from (5' to 3'): AAUUUCUACUGUUGUAGAU (SEQ ID NO: 1093), AAUUUCUGCUGUUGCAGAU (SEQ ID NO: 1094), AAUUUCCACUGUUGUGGAU (SEQ ID NO: 1095), AAUUUCUACUGUUGUAGGU (SEQ ID NO: 1096), AAUUUCUACUAUUGUAGAU (SEQ ID NO: 1097), AAUUUCUACUGCUGUAGAU (SEQ ID NO: 1098), AAUUUCUACUUUGUAGAU (SEQ ID NO: 1099), and AAUUUCUACUUGUAGAU (SEQ ID NO: 1100). The guide sequence can then follow (5' to 3') the duplex forming segment.

A non-limiting example of an activator RNA (e.g. tracrRNA) of a C2c1 guide RNA (dual guide or single guide) is an RNA that includes the nucleotide sequence GAAUUUUUCAACGGGUGUGCCAAUGGCCAC-UUUCCAGGUGGCAAAGCCCGUUGA GCUUCU-CAAAAAG (SEQ ID NO: 1101). In some cases, a C2c1 guide RNA (dual guide or single guide) is an RNA that includes the nucleotide sequence In some cases, a C2c1 guide RNA (dual guide or single guide) is an RNA that includes the nucleotide sequence GUCUA-GAGGACAGAAUUUUUCAACGGGUGUGC-CAAUGGCCACUUUCCAGGUGGC AAAGCCCGUUGAGCUUCUCAAAAAG (SEQ ID NO: 1102). In some cases, a C2c1 guide RNA (dual guide or single guide) is an RNA that includes the nucleotide sequence UCUAGAGGACAGAAUUUUUCAACGGGU-GUGCCAAUGGCCACUUUCCAGGUGGCA AAGCCCGUUGAGCUUCUCAAAAAG (SEQ ID NO: 1103). A non-limiting example of an activator RNA (e.g. tracrRNA) of a C2c1 guide RNA (dual guide or single guide) is an RNA that includes the nucleotide sequence ACUUUCCAGGCAAAGCCCGUUGAGCUUCU-CAAAAAG (SEQ ID NO: 1104). In some cases, a duplex forming segment of a C2c1 guide RNA (dual guide or single guide) of an activator RNA (e.g. tracrRNA) includes the nucleotide sequence AGCUUCUCA (SEQ ID NO: 1105) or the nucleotide sequence GCUUCUCA (SEQ ID NO: 1106) (the duplex forming segment from a naturally existing tracrRNA.

A non-limiting example of a targeter RNA (e.g. crRNA) of a C2c1 guide RNA (dual guide or single guide) is an RNA with the nucleotide sequence CUGAGAAGUGGCACNNNNNNNNNNNNNNNNNNNN (SEQ ID NO: 1107), where the Ns represent the guide sequence, which will vary depending on the target sequence, and although 20 Ns are depicted a range of different lengths are acceptable. In some cases, a duplex forming segment of a C2c1 guide RNA (dual guide or single guide) of a targeter RNA (e.g. crRNA) includes the nucleotide sequence CUGAGAAGUGGCAC (SEQ ID NO: 1108) or includes the nucleotide sequence CUGAGAAGU (SEQ ID NO: 1109) or includes the nucleotide sequence UGAGAAGUGGCAC (SEQ ID NO: 1110) or includes the nucleotide sequence UGAGAAGU (SEQ ID NO: 1111).

Examples and guidance related to type V or type VI CRISPR/Cas endonucleases and guide RNAs (as well as information regarding requirements related to protospacer adjacent motif (PAM) sequences present in targeted nucleic acids) can be found in the art, for example, see Zetsche et al, Cell. 2015 Oct. 22; 163(3):759-71; Makarova et al, Nat Rev Microbiol. 2015 November; 13(11):722-36; and Shmakov et al., Mol Cell. 2015 Nov. 5; 60(3):385-97.

Target Cells

A target nucleic acid (e.g., target genomic DNA) can be located within a eukaryotic cell, for example, inside of a eukaryotic cell in vitro, inside of a eukaryotic cell in vivo, inside of a eukaryotic cell ex vivo. Thus, in some cases, a target cell (e.g., a human cell) of a subject method (a cell into which a class 2 CRISPR/Cas endonuclease and a pair of corresponding CRISPR/Cas guide RNAs can be introduced) is in vitro. In some cases, a target cell (e.g., a human cell) of a subject method (a cell into which a class 2 CRISPR/Cas endonuclease and a pair of corresponding CRISPR/Cas guide RNAs can be introduced) is ex vivo. In some cases, a target cell (e.g., a human cell) of a subject method (a cell into which a class 2 CRISPR/Cas endonuclease and a pair of corresponding CRISPR/Cas guide RNAs can be introduced) is in vivo.

The subject kits, compositions, and methods can be used for research and therapeutic applications. As such, any eukaryotic cell having a region that corresponds to the region of intron 44 through of intron 55 of the human dystrophin gene can be used.

In some cases a target cell (a cell into which a class 2 CRISPR/Cas endonuclease and a pair of corresponding CRISPR/Cas guide RNAs can be introduced) is a cell of a vertebrate animal (e.g., fish, amphibian, reptile, bird, mammal); a cell of a mammal (e.g., a cell of a rodent such as a mouse or rat, a cell of a non-human primate, a cell of a human, etc.); and the like. In some cases a target cell (a cell into which a class 2 CRISPR/Cas endonuclease and a pair of corresponding CRISPR/Cas guide RNAs can be introduced) is a mammalian cell (e.g., a human cell).

Any type of cell may be of interest (e.g. a stem cell, e.g. an embryonic stem (ES) cell, an induced pluripotent stem (iPS) cell, a hematopoietic stem cell, a germ cell (e.g., an oocyte, a sperm, an oogonia, a spermatogonia, etc.), a somatic cell, a muscle cell, an in vitro or in vivo embryonic cell of an embryo at any stage, e.g., a 1-cell, 2-cell, 4-cell, 8-cell, etc. stage zebrafish embryo; etc.). Cells may be from established cell lines or they may be primary cells, where "primary cells", "primary cell lines", and "primary cultures" are used interchangeably herein to refer to cells and cells cultures that have been derived from a subject and allowed to grow in vitro for a limited number of passages, i.e. splittings, of the culture. For example, primary cultures are cultures that may have been passaged 0 times, 1 time, 2 times, 4 times, 5 times, 10 times, or 15 times, but not enough times go through the crisis stage.

If the cell is a primary cell (e.g., a cell ex vivo), it can be harvested from an individual by any convenient method. For example, leukocytes may be conveniently harvested by apheresis, leukocytapheresis, density gradient separation, etc., while cells from tissues such as skin, muscle, bone marrow, spleen, liver, pancreas, lung, intestine, stomach, etc. can be conveniently harvested by biopsy.

In some cases, the cell is a pericyte. A pericyte is a multipotent stem cell that is located within the blood vessels of skeletal muscle. Pericytes can be delivered systemically can cross the vascular barrier. Once past the vasculature, pericytes can fuse and form myotubes. Pericytes can be injected arterially, crossing through arterial walls into muscle, where they can differentiate into functional muscle.

Thus, in some cases, a target cell (a cell into which a class 2 CRISPR/Cas endonuclease and a pair of corresponding CRISPR/Cas guide RNAs can be introduced) is a pericyte (e.g., see Dellavalle et al., Nat Cell Biol. 2007 March; 9(3):255-67). In some cases, the cell is a type 2 pericyte (e.g., which can form myotubes and can be characterized by positive expression for nestin (PDGFR$\beta^+$CD146$^+$NG2$^+$)). In some cases, is a muscle stem cell. In some cases, the cell is a myogenic precursor cell.

The findings of the inventors (e.g., see the examples below) can be used for stem cell therapy of DMD. For example, pericyte-derived cells can be extracted, grown in culture, and then these cells can be injected into the blood stream where they can find their way into injured regions of skeletal muscle.

In some cases, a subject method includes (after introducing a class 2 CRISPR/Cas endonuclease and corresponding first and second CRISPR/Cas guide RNAs into a target cell), a step of transplanting the cell into an individual (e.g., an individual having DMD). In some cases, the cell is autologous to the individual (e.g., cell is harvested from an individual with DMD, the subject components are introduced into the cell to generate a genomic deletion as described elsewhere herein, and the 'corrected' cell and/or cells derived from the 'corrected' cell, e.g., progeny cells, is introduced into the individual).

Nucleic Acids

As noted above, the subject components (e.g., (a) a class 2 CRISPR/Cas endonuclease, e.g., Cas9, Cpf1, etc.; and/or (b) first and second corresponding guide RNAs, e.g., Cas9 guide RNAs, a Cpf1 guide RNAs, etc.) can be delivered to a cell (introduced into a cell) as DNA, RNA, or protein. Thus, in some cases, a subject method or composition or kit includes one or more nucleic acids (RNA or DNA) encoding one or more of: (i) a class 2 CRISPR/Cas endonuclease (e.g., a Cas9 protein), (ii) a first CRISPR/Cas guide RNA (that hybridizes to intron 44, e.g., as described elsewhere herein), and (iii) a second CRISPR/Cas guide RNA (that hybridizes to intron 55, e.g., as described elsewhere herein). In some cases, one nucleic acid (e.g., an expression vector) encodes the first and second CRISPR/Cas guide RNAs. In some cases, the same nucleic acid (e.g., expression vector) also encodes the class 2 CRISPR/Cas endonuclease.

Many vectors, e.g. plasmids, cosmids, minicircles, phage, viruses, etc., useful for transferring nucleic acids into target cells are available. The vectors comprising the nucleic acid(s) may be maintained episomally, e.g. as plasmids, minicircle DNAs, viruses such cytomegalovirus, adenovirus, etc., or they may be integrated into the target cell genome, through homologous recombination or random integration, e.g. retrovirus-derived vectors such as MMLV, HIV-1, ALV, etc.

Vectors may be provided directly to the subject cells. In other words, cells can be contacted with one or more nucleic acids (e.g., vectors) encoding one or more of: (i) the first CRISPR/Cas guide RNA, (ii) the second CRISPR/Cas guide RNA, and (iii) the class 2 CRISPR/Cas endonuclease, such that the vectors are taken up by the cells.

Methods for contacting cells with nucleic acid vectors that are plasmids, including electroporation, calcium chloride transfection, microinjection, and lipofection are known in the art. For viral vector delivery, the cells are contacted with viral particles comprising the nucleic acid. Retroviruses, for example, lentiviruses, are particularly suitable to the method of the invention. Commonly used retroviral vectors are "defective", i.e. unable to produce viral proteins required for productive infection. Rather, replication of the vector requires growth in a packaging cell line. To generate viral particles comprising nucleic acids of interest, the retroviral nucleic acids comprising the nucleic acid are packaged into viral capsids by a packaging cell line. Different packaging cell lines provide a different envelope protein (ecotropic, amphotropic or xenotropic) to be incorporated into the capsid, this envelope protein determining the specificity of the viral particle for the cells (ecotropic for murine and rat; amphotropic for most mammalian cell types including human, dog and mouse; and xenotropic for most mammalian cell types except murine cells). The appropriate packaging cell line may be used to ensure that the cells are targeted by the packaged viral particles. Methods of introducing the retroviral vectors comprising the nucleic acid encoding the reprogramming factors into packaging cell lines and of collecting the viral particles that are generated by the packaging lines are well known in the art. Nucleic acids can also introduced by direct micro-injection (e.g., injection of RNA into a zebrafish embryo).

Vectors used for providing the nucleic acids encoding the first and second CRISPR/Cas guide RNAs, and/or a class 2 CRISPR/Cas endonuclease, to target cells can include suitable promoters for driving expression, that is, transcriptional activation, of the nucleic acid of interest. In other words, the nucleic acid of interest (a nucleotide sequence encoding the first CRISPR/Cas guide RNA, a nucleotide sequence encoding the second CRISPR/Cas guide RNA, a nucleotide sequence encoding a class 2 CRISPR/Cas endonuclease, etc.) can be operably linked to a promoter (e.g., a promoter operable in the target cell). This may include ubiquitously acting promoters, for example, the CMV-β-actin promoter, the EF-1 alpha promoter, and the like, or inducible promoters, such as promoters that are active in particular cell populations or that respond to the presence of drugs such as tetracycline. By transcriptional activation, it is intended that transcription will be increased above basal levels in the target cell by at least about 10 fold, by at least about 100 fold, more usually by at least about 1000 fold. Expression vectors may include nucleic acid sequences that encode for selectable markers in the target cells, so as to identify cells that have taken up the introduced nucleic acid.

As noted above, a promoter can be a constitutively active promoter (i.e., a promoter that is constitutively in an active/"ON" state), it may be an inducible promoter (i.e., a promoter whose state, active/"ON" or inactive/"OFF", is controlled by an external stimulus, e.g., the presence of a particular temperature, compound, or protein.), it may be a spatially restricted promoter (i.e., transcriptional control element, enhancer, etc.)(e.g., tissue specific promoter, cell type specific promoter, etc.), and it may be a temporally restricted promoter (i.e., the promoter is in the "ON" state or "OFF" state during specific stages of embryonic development or during specific stages of a biological process, e.g., hair follicle cycle in mice).

Tissue-specific promoters are known in the art. Non-limiting examples of tissue-specific promoters are muscle cell-specific promoters. Suitable muscle-specific promoters include, e.g., a desmin promoter; an α-myosin heavy chain promoter; a myosin light chain-2 promoter; a cardiac troponin C promoter; a muscle creatine kinase promoter; an α-actinin promoter; a cardiac troponin I promoter; and the like. See, e.g., Pacak et al. (2008) *Genet. Vaccines Ther.* 6:13.

Suitable promoters can be derived from viruses and can therefore be referred to as viral promoters, or they can be derived from any organism, including prokaryotic or eukaryotic organisms. Suitable promoters can be used to drive expression by any RNA polymerase (e.g., pol I, pol II, pol III). Exemplary promoters include, but are not limited to the SV40 early promoter, mouse mammary tumor virus long terminal repeat (LTR) promoter; adenovirus major late promoter (Ad MLP); a herpes simplex virus (HSV) promoter, a cytomegalovirus (CMV) promoter such as the CMV immediate early promoter region (CMVIE), a rous sarcoma virus (RSV) promoter, a human U6 small nuclear promoter (U6) (Miyagishi et al., Nature Biotechnology 20, 497-500 (2002)), an enhanced U6 promoter (e.g., Xia et al., Nucleic Acids Res. 2003 Sep. 1; 31(17)), a human H1 promoter (H1), and the like.

Examples of inducible promoters include, but are not limited to T7 RNA polymerase promoter, T3 RNA polymerase promoter, Isopropyl-beta-D-thiogalactopyranoside (IPTG)-regulated promoter, lactose induced promoter, heat shock promoter, Tetracycline-regulated promoter, Steroidregulated promoter, Metal-regulated promoter, estrogen receptor-regulated promoter, etc. Inducible promoters can therefore be regulated by molecules including, but not limited to, doxycycline; RNA polymerase, e.g., T7 RNA polymerase; an estrogen receptor; an estrogen receptor fusion; etc.

As noted above, a class 2 CRISPR/Cas endonuclease, and/or a CRISPR/Cas guide RNA may be introduced into cells as RNA. Methods of introducing RNA into cells are known in the art and may include, for example, direct injection, transfection, or any other method used for the introduction of DNA.

A class 2 CRISPR/Cas endonuclease (e.g., a Cas9 protein) may be introduced into cells as a polypeptide (e.g., in some cases complexed with a guide RNA, thus forming an RNP). Such a polypeptide may optionally be fused to a polypeptide domain that increases solubility of the product. The domain may be linked to the polypeptide through a defined protease cleavage site, e.g. a TEV sequence, which is cleaved by TEV protease. The linker may also include one or more flexible sequences, e.g. from 1 to 10 glycine residues. In some embodiments, the cleavage of the fusion protein is performed in a buffer that maintains solubility of the product, e.g. in the presence of from 0.5 to 2 M urea, in the presence of polypeptides and/or polynucleotides that increase solubility, and the like. Domains of interest include endosomolytic domains, e.g. influenza HA domain; and other polypeptides that aid in production, e.g. IF2 domain, GST domain, GRPE domain, and the like. The polypeptide may be formulated for improved stability. For example, the peptides may be PEGylated, where the polyethyleneoxy group provides for enhanced lifetime in the blood stream.

Additionally or alternatively, a class 2 CRISPR/Cas endonuclease such as a Cas9 protein may be fused to a polypeptide permeant domain to promote uptake by the cell. A number of permeant domains are known in the art and may be used in the non-integrating polypeptides of the present invention, including peptides, peptidomimetics, and non-peptide carriers. For example, a permeant peptide may be derived from the third alpha helix of *Drosophila melanogaster* transcription factor Antennapaedia, referred to as penetratin, which comprises the amino acid sequence RQIKIWFQNRRMKWKK (SEQ ID NO: 1080). As another example, the permeant peptide comprises the HIV-1 tat basic region amino acid sequence, which may include, for example, amino acids 49-57 of naturally-occurring tat protein. Other permeant domains include poly-arginine motifs, for example, the region of amino acids 34-56 of HIV-1 rev protein, nona-arginine, octa-arginine, and the like. (See, for example, Futaki et al. (2003) Curr Protein Pept Sci. 2003 April; 4(2): 87-9 and 446; and Wender et al. (2000) Proc. Natl. Acad. Sci. U.S.A 2000 Nov. 21; 97(24):13003-8; published U.S. Patent applications 20030220334; 20030083256; 20030032593; and 20030022831, herein specifically incorporated by reference for the teachings of translocation peptides and peptoids). The nona-arginine (R9) sequence is one of the more efficient PTDs that have been characterized (Wender et al. 2000; Uemura et al. 2002). The site at which the fusion is made may be selected in order to optimize the biological activity, secretion or binding characteristics of the polypeptide. The optimal site will be determined by routine experimentation.

A class 2 CRISPR/Cas endonuclease (e.g., a Cas9 protein) can be produced in vitro or by eukaryotic cells or by prokaryotic cells, and it may be further processed by unfolding, e.g. heat denaturation, DTT reduction, etc. and may be further refolded, using methods known in the art.

Modifications of interest that do not alter primary sequence include chemical derivatization of polypeptides, e.g., acylation, acetylation, carboxylation, amidation, etc. Also included are modifications of glycosylation, e.g. those made by modifying the glycosylation patterns of a polypeptide during its synthesis and processing or in further processing steps; e.g. by exposing the polypeptide to enzymes which affect glycosylation, such as mammalian glycosylating or deglycosylating enzymes. Also embraced are sequences that have phosphorylated amino acid residues, e.g. phosphotyrosine, phosphoserine, or phosphothreonine.

A class 2 CRISPR/Cas endonuclease, e.g., a Cas9 protein, can be isolated and purified, e.g., in accordance with conventional methods of recombinant synthesis. A lysate may be prepared of the expression host and the lysate purified using HPLC, exclusion chromatography, gel electrophoresis, affinity chromatography, or other purification technique. For the most part, the compositions which are used can comprise at least 20% by weight of the desired product, more usually at least 75% by weight, e.g., at least 95% by weight, and for therapeutic purposes, e.g., at least 99.5% by weight, in relation to contaminants related to the method of preparation of the product and its purification. The percentages can be based upon total protein.

The components of the methods and compositions (and kits) described herein can be introduced into a cell using any convenient method. For example, a genome targeting composition can be introduced into cells in various forms, including: (i) as an RNP (e.g., comprising a class 2 CRISPR/Cas endonuclease, e.g., a Cas9 protein, and corresponding first and second guide RNAs, e.g., Cas9 guide RNAs); (ii) as protein (e.g., a class 2 CRISPR/Cas endonuclease); (iii) as RNA (e.g., a CRISPR/Cas guide RNA, an RNA encoding a class 2 CRISPR/Cas endonuclease, etc.); (iv) as DNA (e.g., a DNA encoding a genome editing endonuclease, a DNA encoding CRISPR/Cas guide RNAs, etc.); and (v) any combination thereof.

Examples of ways to introduce the above components include but are not limited to: viral or bacteriophage infection, transfection, conjugation, protoplast fusion, lipofection, electroporation, calcium phosphate precipitation, polyethyleneimine (PEI)-mediated transfection, DEAE-dextran mediated transfection, liposome-mediated transfection, particle gun technology, calcium phosphate precipitation, direct micro injection, nanoparticle-mediated nucleic acid delivery (see, e.g., Panyam et., al Adv Drug Deliv Rev. 2012 Sep. 13. pii: S0169-409X(12)00283-9. doi: 10.1016/j.addr.2012.09.023), and the like.

The components can be introduced into a cell in vivo (e.g., administered to an individual) using any convenient method (e.g., local or systemic, injection, local or system injection, oral, parenteral, subcutaneous, intravenous, intracranial, intraspinal, intraocular, into spinal fluid, and the like). In some cases, introduction can include nucleofection, electroporation, and the like. In some cases, introduction does not include nucleofection or electroporation.

Kits

In some cases, a subject kit and/or subject composition includes a first CRISPR/Cas guide RNA (e.g., that hybridizes to a first target sequence within intron 44 of the dystrophin gene, e.g., as described in more detail above), and (b) a second CRISPR/Cas guide RNA (e.g., that hybridizes to a second target sequence within intron 55 of the dystrophin gene, e.g., as described in more detail above), where the first and second target sequences are separated from each other by greater than 330 kb.

In some cases, the guide sequence of the first CRISPR/Cas guide RNA (e.g., a Cas9 guide RNA) comprises the 17 nucleotide sequence set forth in any of SEQ ID NOs: 1155-1159. In some cases, the guide sequence of the first CRISPR/Cas guide RNA (e.g., a Cas9 guide RNA) comprises the 20 nucleotide sequence set forth in any of SEQ ID NOs: 1150-1154. In some cases, the guide sequence of the second CRISPR/Cas guide RNA (e.g., a Cas9 guide RNA) comprises the 17 nucleotide sequence set forth in any of SEQ ID NOs: 1175-1179. In some cases, the guide sequence of the first CRISPR/Cas guide RNA (e.g., a Cas9 guide RNA) comprises a nucleotide sequence set forth in any of SEQ ID NOs: 1223-1269. In some cases, the guide sequence of the second CRISPR/Cas guide RNA (e.g., a Cas9 guide RNA) comprises the 20 nucleotide sequence set forth in any of SEQ ID NOs: 1170-1174. In some cases, the guide sequence of the second CRISPR/Cas guide RNA (e.g., a Cas9 guide RNA) comprises a nucleotide sequence set forth in any of SEQ ID NOs: 1318-1365.

In some cases, the guide sequence of the first CRISPR/Cas guide RNA (e.g., a Cas9 guide RNA) comprises the 17 nucleotide sequence set forth in any of SEQ ID NOs: 1155-1159, and the guide sequence of the second CRISPR/Cas guide RNA (e.g., a Cas9 guide RNA) comprises the 17 nucleotide sequence set forth in any of SEQ ID NOs: 1175-1179. In some cases, the guide sequence of the first CRISPR/Cas guide RNA (e.g., a Cas9 guide RNA) comprises the 20 nucleotide sequence set forth in any of SEQ ID NOs: 1150-1154, and the guide sequence of the second CRISPR/Cas guide RNA (e.g., a Cas9 guide RNA) comprises the 20 nucleotide sequence set forth in any of SEQ ID NOs: 1170-1174.

In some cases, the guide sequence of the first CRISPR/Cas guide RNA (e.g., a Cas9 guide RNA) comprises the 17 nucleotide sequence GAAAUUAAACUACACAC (SEQ ID NO: 1158), and the guide sequence of the second CRISPR/Cas guide RNA (e.g., a Cas9 guide RNA) comprises the 17 nucleotide sequence AUGAUGCUAUAAUACCA (SEQ ID NO: 1177). In some cases, the guide sequence of the first CRISPR/Cas guide RNA (e.g., a Cas9 guide RNA) comprises the 20 nucleotide sequence GUUGAAAUUAAAC-UACACAC (SEQ ID NO: 1153) and the guide sequence of the second CRISPR/Cas guide RNA (e.g., a Cas9 guide RNA) comprises the 20 nucleotide sequence UGUAUGAUGCUAUAAUACCA (SEQ ID NO: 1172).

In some cases, the guide sequence of the first CRISPR/Cas guide RNA (e.g., a Cas9 guide RNA) has 100% complementarity over 20 contiguous nucleotides with a target sequence corresponding to intron 44 of the human dystrophin gene (e.g., a target sequence within intron 44 of the human dystrophin gene, a target sequence within a mouse dystrophin gene, etc.), and the guide sequence of the second CRISPR/Cas guide RNA (e.g., a Cas9 guide RNA) has 100% complementarity over 20 contiguous nucleotides with a target sequence corresponding to intron 55 of the human dystrophin gene (e.g., a target sequence within intron 55 of the human dystrophin gene, a target sequence within a mouse dystrophin gene, etc.). In some such cases, the target sequence corresponding to intron 44 and the target sequence corresponding to intron 55 are separated from each other by greater than 330 kilobases (kb). In some cases, the target sequence corresponding to intron 44 and the target sequence corresponding to intron 55 are separated from each other by 400 kilobases (kb) or more (e.g., 450 kb or more, 500 kb or more, 550 kb or more, 600 kb or more, 650 kb or more, 700 kb or more, etc.). In some cases, the target sequence within intron 44 and the target sequence within intron 55 are separated from each other by 700 kb or more.

In some cases, the guide sequence of the first CRISPR/Cas guide RNA (e.g., a Cas9 guide RNA) has 100% complementarity over 17 contiguous nucleotides with a target sequence corresponding to intron 44 of the human dystrophin gene, and the guide sequence of the second CRISPR/Cas guide RNA (e.g., a Cas9 guide RNA) has 100% complementarity over 17 contiguous nucleotides with a target sequence corresponding to intron 55 of the human dystrophin gene. In some such cases, the target sequence corresponding to intron 44 and the target sequence corresponding to intron 55 are separated from each other by greater than 330 kilobases (kb). In some cases, the target sequence corresponding to intron 44 and the target sequence corresponding to intron 55 are separated from each other by 400 kilobases (kb) or more (e.g., 450 kb or more, 500 kb or more, 550 kb or more, 600 kb or more, 650 kb or more, 700 kb or more, etc.). In some cases, the target sequence within intron 44 and the target sequence within intron 55 are separated from each other by 700 kb or more.

In some cases, a subject kit can further include a class 2 CRISPR/Cas endonuclease (e.g., a Cas9 protein), or a nucleic acid encoding the endonuclease.

Components (a) and (b) of a subject kit can be in the same or separate containers.

A composition and/or kit can further include one or more additional reagents, e.g., selected from: a dilution buffer; a reconstitution solution; a wash buffer; a control reagent; a control expression vector or RNA polynucleotide; a reagent for in vitro production of a class 2 CRISPR/Cas endonuclease from DNA or RNA, a reagent for in vitro production of a CRISPR/Cas guide RNA from DNA, and the like.

In addition to above-mentioned components, a subject kit can further include instructions for using the components of the kit to practice the subject methods. The instructions for practicing the subject methods are generally recorded on a suitable recording medium. For example, the instructions may be printed on a substrate, such as paper or plastic, etc. As such, the instructions may be present in the kits as a package insert, in the labeling of the container of the kit or components thereof (i.e., associated with the packaging or subpackaging) etc. In other embodiments, the instructions are present as an electronic storage data file present on a suitable computer readable storage medium, e.g. CD-ROM, diskette, flash drive, etc. In yet other embodiments, the actual instructions are not present in the kit, but means for obtaining the instructions from a remote source, e.g. via the internet, are provided. An example of this embodiment is a kit that includes a web address where the instructions can be viewed and/or from which the instructions can be downloaded. As with the instructions, this means for obtaining the instructions is recorded on a suitable substrate.

EXAMPLES

The following examples are put forth so as to provide those of ordinary skill in the art with a complete disclosure and description of how to make and use the present invention, and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Celsius, and pressure is at or near atmospheric. Standard abbreviations may be used, e.g., bp, base pair(s); kb, kilobase(s); pl, picoliter(s); s or sec, second(s); min, minute(s); h or hr, hour(s); aa, amino acid(s); kb, kilobase(s); bp, base pair(s); nt, nucleotide(s); i.m., intramuscular(ly); i.p., intraperitoneal (ly); s.c., subcutaneous(ly); and the like.

Materials and Methods

Cloning of gRNAs

Five guide RNAs were designed to target DMD introns 44 and 55 using the Zhang lab CRISPR design tool ("crispr.mit" followed by ".edu") and cloned into the spCas9 plasmids pX330 or pX459 from Feng Zhang (Addgene #42230, #48139 respectively) adapted from Ran et al. (Nature Protocols, 2013. 8:2281-2308). In brief, oligos complementary to each other containing the gRNA sequence and BbsI restriction enzyme site were obtained from Integrated DNA Technologies and annealed. The annealed oligos and plasmid were simultaneously digested with BbsI (New England Biotechnologies) and ligated with T4 DNA ligase (Life Technologies).

Laboratory) with NOD scid IL2Rgamma (Jackson Laboratory) mice. Briefly, female B10ScSn.Cg-Prkdc$^{scid}$Dmd$^{mdx}$/J were crossed with male NOD.Cg-Prkdc$^{scid}$Il2$^{tm1Wjl}$/SzJ. Then the F1 females from that cross were crossed with male mdx-scid. The F3 males were screened for dystrophin and gamma mutations and the mutants were then backcrossed again with mdx-scid females. F4 females were crossed with F3 mutant males which generated homozygous NSG-mdx mice. Genotyping was performed through TransnetYX.

Cell Culture

Human embryonic kidney (HEK) 293FT cells (Life Technologies) were grown in standard conditions with growth medium consisting of DMEM (high glucose) with 10% fetal bovine serum (FBS, Life Technologies), 0.1 mM non-essential amino acids (NEAA, Life Technologies), 6 mM L-glutamine (Life Technologies).

Human skeletal muscle myoblasts (HSMM, Lonza) were maintained according to the manufacturer's instructions with SkGM-2 medium (Lonza). For terminal differentiation, they were cultured on Matrigel (Corning) until at least 80% confluent and then switched to N2 differentiation medium

TABLE 3 gRNA sequences and oligos used for cloning

| Name | Non-complementary strand of target sequence | Sense oligo | Antisense oligo |
|---|---|---|---|
| 44C1 | GTGGTGTCCTTTGAAT ATGCAGG (SEQ ID NO: 1368) | CACCGTGGTGTCCTTT GAATATGC (SEQ ID NO: 1378) | AAACGCATATTCAAA GGACACCAC (SEQ ID NO: 1388) |
| 44C2 | AGATTGTCCAGGATA TAATTTGG (SEQ ID NO: 1369) | CACCGAGATTGTCCA GGATATAATT (SEQ ID NO: 1379) | AAACAATTATATCCT GGACAATCTC (SEQ ID NO: 1389) |
| 44C3 | TTAGCAACCAAATTA TATCCTGG (SEQ ID NO: 1370) | CACCGTTAGCAACCA AATTATATCC (SEQ ID NO: 1380) | AAACGGATATAATTT GGTTGCTAAC (SEQ ID NO: 1390) |
| 44C4 | GTTGAAATTAAACTA CACACTGG (SEQ ID NO: 1371) | CACCGTTGAAATTAA ACTACACAC (SEQ ID NO: 1381) | AAACGTGTGTAGTTT AATTTCAAC (SEQ ID NO: 1391) |
| 44C5 | ATCTTTACCTGCATAT TCAAAGG (SEQ ID NO: 1372) | CACCGATCTTTACCTG CATATTCAA (SEQ ID NO: 1382) | AAACTTGAATATGCA GGTAAAGATC (SEQ ID NO: 1392) |
| 55C1 | TACACATTTTTAGGCT TGACAGG (SEQ ID NO: 1373) | CACCGTACACATTTTT AGGCTTGAC (SEQ ID NO: 1383) | AAACGTCAAGCCTAA AAATGTGTAC (SEQ ID NO: 1393) |
| 55C2 | CATTCCTGGGAGTCT GTCATGGG (SEQ ID NO: 1374) | CACCGCATTCCTGGG AGTCTGTCAT (SEQ ID NO: 1384) | AAACATGACAGACTC CCAGGAATGC (SEQ ID NO: 1394) |
| 55C3 | TGTATGATGCTATAAT ACCAAGG (SEQ ID NO: 1375) | CACCGTGTATGATGC TATAATACCA (SEQ ID NO: 1385) | AAACTGGTATTATAG CATCATACAC (SEQ ID NO: 1395) |
| 55C4 | GTGGAAAGTACATAG GACCTTGG (SEQ ID NO: 1376) | CACCGTGGAAAGTAC ATAGGACCT (SEQ ID NO: 1386) | AAACAGGTCCTATGT ACTTTCCAC (SEQ ID NO: 1396) |
| 55C5 | TCTTATCATAACTCTT ACCAAGG (SEQ ID NO: 1377) | CACCGTCTTATCATAA CTCTTACCA (SEQ ID NO: 1387) | AAACTGGTAAGAGTT ATGATAAGAC (SEQ ID NO: 1397) |

Bold and underlined text is NGG PAM sequence.

Mice

All animal work was conducted under protocols approved by the UCLA Animal Research Committee in the Office of Animal Research Oversight. Mice used for engraftment experiments were generated by crossing mdx scid (Jackson (DMEM/F12 with 1% N2 supplement (Life Technologies) and 1% insulin-transferrin-selenium (ITS, Life Technologies)) for 7 days.

Human induced pluripotent stem cells (hiPSCs) were reprogrammed from skin fibroblasts with the STEMCCA cassette as previously described (Karumbayaram et al., Stem Cells Transl. Med., 2012. 1:36-43). They were grown on hESC qualified Matrigel (Corning), fed daily with mTeSR1 medium (Stem Cell Technologies) and passaged with 0.5 mM EDTA every 5-7 days. Karyotype and FISH analyses were performed by Cell Line Genetics.

Teratoma Injections

To prepare hiPSCs for injection, 1-2 confluent wells were collected using 1 mg/ml of collagenase type IV or 0.5 mM EDTA. Colonies were dissociated using a 5 ml pipette and centrifuged at 1000 rpm. Cell pellets were resuspended in 40 μl of Hank's Balanced Salt Solution (HBSS) and injected into the testes of 6-8 week-old SCID BEIGE mice (Charles River) as described previously (Alva et al., Stem Cells, 2011. 29:1952-1962). After 4-8 weeks, teratomas were isolated and fixed in 4% paraformaldehyde (PFA) for 24 hours, then 70% ethanol. Fixed teratomas were embedded and processed by the Tissue Procurement Core Laboratory, Department of Pathology and Laboratory Medicine, David Geffen School of Medicine at UCLA. If teratomas were large, four to six quadrants were isolated and fixed in PFA as described above. Tumors were stained with hematoxylin and eosin and imaged with an Olympus BX51 microscope.

Transfection and Nucleofection of gRNAs $3 \times 10^5$ HEK293FT cells were seeded per 12 well and transfected in duplicate the following day with 1 μg DNA using 3 μl TransIT293 (Minis Bio) according to the manufacturer's instructions.

Amaxa 4D (Lonza) nucleofection of hiPSCs was performed according to the manufacturer's instructions. In brief, hiPSCs were pre-treated with 10 μM ROCK inhibitor Y-27632 (ROCKi, Tocris Bioscience) for 1 hr and trypsinized into a single cell suspension with TrypIE (Life Technologies). $8 \times 10^5$ hiPSCs were nucleofected per 100 μl cuvette using solution P3, 2 μg or 3.5 μg total DNA, and program CA-137 (Lonza). pMAX GFP (Lonza) was used as a transfection control. After nucleofection, cells were immediately plated in mTeSR1 with ROCKi. For selection, 0.35 μg/ml of puromycin in mTeSR1 was added to the cells for 24 hrs the day after nucleofection.

Generation of Clonal hiPSC Lines

For generation of clonal lines, the day following nucleofection of gRNAs 44C4 and 55C3 (in pX459) cells were selected with 0.35 μg/ml of puromycin in mTeSR1 for one day. The cells were expanded for 7-9 days in mTeSR1 and then either single cell sorted in ROCKi using a FACSAria sorter (BD) into individual 96 wells or plated at low densities of $3 \times 10^5$-$5 \times 10^5$ cells per 10 cm dish in mTeSR1 plus ROCKi. After 2 weeks, individual colonies were scrapped into a corresponding 48 well and a subset of the colony was manually dissected and screened using the deletion genotyping PCR below.

Deletion Genotyping PCR

For determining if the exon 45-55 deletion occurred, either individual PCR reactions or a multiplex PCR containing both sets of primers was performed with AccuPrime Taq High Fidelity (Life Technologies). One primer pair flanked the deleted region (del) and one pair was within the deleted region (undel). PCR products were run on a 1.2% agarose gel and visualized with ethidium bromide staining.

TABLE 4

Primer sequences for PCR (genotyping)

| Primer name, purpose | Sequence |
|---|---|
| 44_F, forward primer for del genotyping | CTGGACGGAGCTGGTTTATCT (SEQ ID NO: 1398) |

TABLE 4-continued

Primer sequences for PCR (genotyping)

| Primer name, purpose | Sequence |
|---|---|
| 55surv2_R, reverse primer for del genotyping | CCCTTTTCTTGGCGTATTGCC (SEQ ID NO: 1399) |
| 55undel1_F, forward primer for undel genotyping | GCCTGGGTCTCTGCTATCAA (SEQ ID NO: 1400) |
| 55undel1_R, reverse primer for undel genotyping | GCCACTTTGTACTCCGCACT (SEQ ID NO: 1401) |

Analysis of the rejoining sequence after an exon 45-55 deletion was performed by blunt cloning the deleted PCR products into the Zero Blunt TOPO backbone (Life Technologies), according to the manufacturer's instructions, and sequencing of the insert by Laragen Inc.

Differentiation of hiPSC-Derived Skeletal Muscle hiPSCs were differentiated into skeletal muscle cells by overexpression of MyoD, adapted from Abujarour et al. (Stem Cells Trans. Med., 2014. 3:149-160). Cells were trypsinized with TrypIE and plated as single cells on Matrigel in SMC4 (basal medium: DMEM/F-12 with 20% knockout serum replacement (KOSR, Life Technologies), 1% NEAA, 1% Glutamax (Life Technologies), 100 μM beta-mercaptoethanol, 10 ng/mL basic fibroblast growth factor (bFGF, Life Technologies); SMC4: basal media with daily addition of 5 μM ROCKi, 0.4 μM PD0325901 (Sigma-Aldrich), 2 μM SB431542 (Tocris Bioscience), 1 μM CHIR99021 (Tocris Bioscience)) at $3.5 \times 10^5$ cells/6 well. When they reached approximately 60-80% confluent they were infected with 0.06 μg/mL of a tamoxifen inducible MyoD-ERT lentivirus (adapted from Kimura et al., Hum. Mol. Genet., 2008. 17:2507-2517) with 4 μg/mL protamine sulfate per well and spun inoculated at 1250 rpm for 90 mins at 32° C. After a day of recovery they were selected with 2 μg/ml puromycin in SMC4 for 2 days. The cells were then split and plated on Matrigel in basal medium without bFGF plus 10 μM ROCKi at approximately $1 \times 10^5$ cells/cm² and induced in DMEM with 15% FBS and 5 μM tamoxifen for 4 days. Following induction, the cells were differentiated in low glucose DMEM with 5% horse serum and 1 μM tamoxifen for 5-7 days. Medium was changed daily.

An alternative protocol for MyoD overexpression was used for engraftment. Cells were single cell plated at $2.5 \times 10^4$ cells/cm² on Matrigel in mTeSR1 with ROCKi. Beginning the following day, they were treated with 3 μM CHIR99021 in DMEM/F12 with 1% ITS for 2 days. The cells were split to approximately $6 \times 10^4$ cells/cm² in DMEM with 10% FBS and 1% NEAA and infected with the MyoD-ERT lentivirus as above. After a day of recovery, the cells were selected with 1 μg/ml puromycin for 4 days followed by induction in IMDM containing 15% FBS, 10% horse serum (HS), 1% chick embryo extract, 50 μg/ml ascorbic acid, 4.5 mM monothioglycerol, 5 ng/ml bFGF with 5 μM tamoxifen for 2 days and used for engraftment as described below.

A directed differentiation protocol for hiPSCs adapted from Shelton et al. (Stem Cell Reports, 2014. 3:516-529) was also used to obtain SMPCs. Cells were single cell plated in mTeSR1 with 10 μM ROCKi at $3.75 \times 10^5$ cells/6 well. The following day, 10 μM of CHIR99021 was added in Essential 6 medium (E6, Stem Cell Technologies) for 2 days and the cells were allowed to differentiate until day 12 in E6. StemPro (Gibco) containing 20 ng/ml bFGF was added between days 12 to 20. E6 was then added until day 35 when the cells were switched to N2 medium in order to terminally differentiate. At day 50, cells were fluorescently activated cell sorted to remove neural crest cells with HNK1 (1:300, Sigma-Aldrich) and enrich for SMPCs with BV650-NCAM$^+$ (1:25, BD Bioscience). The SMPCs were cultured in expansion media (20% FBS, 5% HS, 1% chick embryo extract, 0.5% penicillin/streptomycin) until confluent when they were changed to N2 medium for 7 days to induce terminal differentiation.

Differentiation of hiPSC-Derived Cardiomyocytes

Confluent hiPSCs were enzymatically dissociated to form aggregates and differentiated into the cardiomyocyte lineage (e.g., see Arshi et al. 2013; Minami et al. 2012). The medium was changed every 2 days up to day 15, and every 5 days up to day 30. At day 30, cardiomyocytes were harvested for analysis or subjected to the hypoosmotic stress assay.

Surveyor Assay

For testing the activity of different gRNAs, genomic DNA (gDNA) was extracted on day 3 or 4 after transfection/nucleofection using the Quick gDNA mini prep kit (Zymo Research) or Quick Extract DNA Extraction Solution 1.0 (Epicenter) according to the manufacturer's instructions. PCR for use in Surveyor assay was performed with AccuPrime Taq High Fidelity with primers flanking the target region.

The Surveyor assay (Integrated DNA Technologies) was performed according to the manufacturer's instructions. In brief, approximately 300 ng of PCR product in 1× AccuPrime buffer up to 20 µl was denatured and reannealed by heating at 95° C. for 10 min and slowly step-wise cooling to 4° C. Then 2 µl MgCl$_2$, 1 µl Surveyor enhancer, and 1.2 µl Surveyor enzyme were added and incubated at 42° C. for 1 hr. The G/C plasmids provided in the Surveyor kit were used as a positive control for every gel. The products were run on a 6% or 4-20% TBE polyacrylamide gel (Bio-Rad) and visualized with ethidium bromide staining. The percent of cutting was determined using ImageJ (Rasband, ImageJ, U. S. Natl. Institutes Heal., 1997).

TABLE 5

Primer sequences for PCR (Surveyor assay)

| Primer name, purpose | Sequence |
| --- | --- |
| 44surv_F, forward primer for intron 44 surveyor | GAGAGTTTGCCTGGACGGA (SEQ ID NO: 1402) |
| 44surv_R, reverse primer for intron 44 surveyor | CCTCTCTATACAAATGCCAACGC (SEQ ID NO: 1403) |
| 55surv2_F, forward primer for intron 55 surveyor | TCCAGGCCTCCTCTCTTTGA (SEQ ID NO: 1404) |
| 55surv2_R, reverse primer for intron 55 surveyor | CCCTTTTCTTGGCGTATTGCC (SEQ ID NO: 1405) |

Hypoosmotic Stress CK Release Assay

Terminally differentiated skeletal muscle cells and cardiomyocytes plated in duplicate were stressed by incubation in hypoosmolar solutions ranging from 66-240 mosmol. Hypoosmolar salt solutions ranging from 66-240 mosmol were made by adding varying amounts of sucrose (~25-175 mM) to a basic salt solution consisting of 5 mM HEPES, 5 mM KCl, 1 mM MgCl$_2$, 5 mM NaCl, 1.2 mM CaCl$_2$, 1 mM glucose. Osmolarities were measured with a Wescor Vapro 5520 osmometer.

Differentiated MyoD OE skeletal myotubes and cardiomyocytes were plated in a 384 or 96 well plate in duplicate per condition tested. 100 µl (or 30 µl for 384 well plates) of the hypoosmolar solution was added to each well and the cells were incubated at 37° C. for 20 mins. The solution (supernatant) was then removed and stored at −80° C. until CK analysis. The cells were trypsinized and lysed in 100 µl dI water by repeated freeze/thawing three times. The lysate was stored at −80° C. until CK analysis. CK was measured in triplicate with 2 µl or 8 µl of undiluted sample using the Creatine Kinase-SL kit (Sekisui Diagnostics) according to the manufacturer's instructions. Any negative readings were forced to be 0 and outliers were discounted from the analysis. The percent of CK release into the supernatant was determined and the standard error was propagated throughout all calculations.

RNA Extraction, cDNA, and PCR

RNA was extracted from differentiated cardiomyocytes using the RNeasy Micro Kit (Qiagen) according to the manufacturer's instructions. cDNA synthesis was performed on 50-250 ng of RNA using the iScript Reverse Transfection Supermix for RT-qPCR (Bio-Rad). Two PCR reactions were done on all samples, one with primers internal to the deletion and one with primers flanking the deletion for 40 cycles using AccuPrime Taq. PCR products were cloned using the TOPO-TA cloning kit (Life Technologies) according to the manufacturer's instructions and sequenced at the UCLA GenoSeq Core.

TABLE 6

Primer sequences for PCR (RNA extraction)

| Primer name, purpose | Sequence |
| --- | --- |
| DMD_E43-44_F, forward primer for cDNA, deleted | CCGACAAGGGCGATTTGACA (SEQ ID NO: 1406) |
| DMD_E57_R, reverse primer for cDNA, deleted | AAGTCGCCTCCAATAGGTGC (SEQ ID NO: 1407) |
| DMD_E52_F, forward primer for cDNA, undeleted | ACTCATTACCGCTGCCCAAA (SEQ ID NO: 1408) |
| DMD_E55_R, reverse primer for cDNA, undeleted | TCTTCCAAAGCAGCCTCTCG (SEQ ID NO: 1409) | miRNA Extraction, cDNA, and ddPCR miRNA was isolated from fused myotubes obtained by MyoD OE using a microRNA purification kit (Norgen Biotek Corp) according to the manufacturer's instructions. cDNA synthesis was performed on 5 µl of miRNA with TaqMan microRNA reverse transcription kit (Applied Biosystems) using a TaqMan MicroRNA Assay (Applied Biosystems) for hsa-miR-31 (assay ID 002279) and U6 snRNA (assay ID 001973) with specific RT primers. PCR reactions were prepared in a premix of 22 µl with 1.46 µl of cDNA (either diluted 1:30 for U6 or undiluted for miR31) in ddPCR supermix for probes (without UTP) (Bio-Rad) and 1.1 µl 20×TaqMan assay probes for each sample in duplicate. 20 µl of the PCR reaction premix was used to generate droplets according to the manufacturer's protocol. Briefly, PCR premix was added to a droplet generator cartridge with 70 µl of oil and droplets were generated with the QX200 droplet generator (Bio-Rad). 40 µl of this reaction mix was transferred to a PCR plate and run on at T100 thermal cycler (Bio-Rad) at 95° C. for 10 mins, 40 cycles of 95° C. 15 sec, 60° C. for 60 sec, followed by 98° C. for 10 mins. A no template control was included for each PCR reaction. FAM fluorescence was evaluated using the QX200 droplet reader and QuantaSoft software (Bio-Rad). The percent of positive droplets for miR31 was normalized to the percent of positive droplets for U6. Standard deviation error was propagated through all calculations. All lines were normalized to CDMD 1002 wild type.

Engraftment into Immunodeficient Mice

NOD scid IL2Rgamma (NSG) immunodeficient mice (Jackson Laboratory) were crossed to mdx scid mice (Jackson Laboratory) to generate NSG-mdx mice, see above. 24 hrs prior to engraftment, the right tibialis anterior (TA) of 5-7 week-old NSG-mdx mice was pretreated with 50 µl of 10 µM cardiotoxin (Sigma-Aldrich). For MyoD OE cells, 100 µL of 5 mg/ml tamoxifen (Sigma-Aldrich) was also IP injected for 5 days with tamoxifen pretreatment starting the day before engraftment (Muir et al., Mol. Ther. Methods Clin. Dev., 2014. 1:14025). $1 \times 10^6$ cells obtained from MyoD OE after induction were pelleted and resuspended in 5 µL HBSS and injected intramuscularly into the TA. Tissue was harvested after 30 days and analyzed as described below. Engraftment was considered successful when human cells that were both lamin A/C and spectrin positive were identified. Successful engraftment was seen in the following: CDMD 1002 N=4/4 engrafted successfully; CDMD 1003 N=1/1 engrafted successfully; and CDMD 1003-49 N=1/2 engrafted successfully.

Immunostaining hiPSCs were fixed in 4% PFA for 20 mins, permeabilized with 0.3% Triton X for 10 mins and blocked in 10% goat serum for 1 hr. Primary antibodies to SOX2 (1:200, Cell Signaling) and NANOG (1:800, Cell Signaling) were added in 1% goat serum and 0.1% Triton X overnight at 4° C. followed by secondary antibodies for 2 hrs the following day.

Differentiated skeletal myotubes obtained from MyoD overexpression were fixed in 80% acetone for 7 mins at −20° C., blocked with 10% goat serum for 1 hr and stained with dystrophin (1:300, Abcam) and myosin heavy chain (1.9 µg/ml, MF20, DHSB) as above. Differentiated cardiomyocytes and skeletal myotubes obtained from the 50 day directed differentiation protocol were fixed in 4% PFA for 20 mins, permeabilized with 0.3% Triton X for 10 mins, blocked in 10% goat serum for 1 hr and stained with dystrophin (1:5, MANDYS106, MDA Monoclonal Antibody Resource, (Man and Morris, Am. J. Hum. Genet., 1993. 52:1057-1066)) or beta-dystroglycan (1:100, Leica Biosystems) and myosin heavy chain (1.9 µg/ml, MF20, DHSB). Images were obtained with the Axio Observer Z1 microscope (Zeiss).

Harvested TA muscles were flash frozen in isopentane. 10 µm cryosections were obtained at intervals throughout the entire muscle and stored at −20° C. For staining, they were blocked in 0.25% gelatin, 0.1% Tween, 3% bovine serum albumin for 1 hr. The M.O.M. blocking kit (Vector Laboratories) was applied according to the manufacturer's instructions. Primary antibodies consisting of human lamin A/C (1:125, Vector Laboratories), human spectrin (1:75, Leica Biosystems), human dystrophin (1:5, MANDYS106), laminin (1:200, Sigma-Aldrich), dystrophin (1:75, Abcam), and beta-dystroglycan (1:50, Leica Biosystems) were applied overnight at 4° C. The following day secondary antibodies were incubated for 1 hr and the slides were mounted with VECTASHIELD containing DAPI (Vector Laboratories) and imaged on the Axio Observer Z1 microscope.

Western Blot Analysis

Terminally differentiated skeletal muscle cells and cardiomyocytes were trypsinized, pelleted, and flash frozen in liquid nitrogen. Cell pellets were stored in liquid nitrogen until lysis. For Western blotting, samples were prepared as described in Woo et al. (Exp. Mol. Med., 2010. 42:614-627) with slight modifications. In brief, cells were solubilized in 500 µl of lysis buffer (10 mM Tris-HCl (pH 7.4), 1% Triton X-100, 10% glycerol, 150 mM NaCl, 5 mM EDTA, and HALT protease and phosphatase inhibitor cocktail (ThermoScientific)) per a 10 cm culture dish, followed by incubation at 4° C. for 30 min with gentle rotation. Then lysates were mixed with 100 µl of 6×RSB and passed several times through a syringe needle to reduce viscosity. Afterwards samples were boiled for 3 min, cooled on ice, passed through a syringe needle again and centrifuged for 5 min at 13,000 g. Clarified lysates were transferred to new tubes, aliquoted and stored at −80° C. till use. To evaluate dystrophin and MyHC content, cell lysates were subjected to 6% polyacrylamide gel electrophoresis (PAGE) for 3 hours at constant current (10 mA per gel); followed by blotting to nitrocellulose membrane at constant voltage (100 V) for 2.5 hours on ice. 0.1% sodium dodecyl sulfate (SDS) and 10 mM dithiothreitol (DTT) was added to the transfer buffer to facilitate blotting of high molecular proteins Immunoblot assay was carried out with mouse anti-MyHC (1:1,000; MF20, DHSB), and mouse anti-dystrophin (1:500; Mandys8, Sigma-Aldrich) antibodies. Secondary antibodies used were anti-mouse peroxidase conjugates from Sigma-Aldrich (1:10,000). Blots were developed using ChemiGlow West chemiluminescent detection kit (ProteinSimple). Signals were registered by the FluorChem FC2 digital imaging system (Alpha Innotech).

For β-dystroglycan, a 7.5% PAGE gel was run for 1.5 hrs at 100 V. Transfer was performed in Tris/Glycine with 20% MetOH for 1 hr 15 min at 100 V Immunoblotting was performed with mouse anti-β-dystroglycan (1:200, MANDAG2(7D11), DHSB) and MyHC antibody as above.

Off Target Analysis

The top 10 unique off target sites for each gRNA used (44C4 and 55C3) were determined with COSMID (Cradick et al., Mol. Ther. Nucleic Acids, 2014. 3:e214) using the following criteria: NRG PAM, 3 mismatches with no indels, and 2 mismatches with 1-base deletions or insertions. Access Array primers corresponding to the potential off target locations were designed, manufactured and validated by Fluidigm. gDNA extracted from the parental and deleted clonal lines was run on an Access Array (Fluidigm) and sequenced with MiSeq in the UCLA GenoSeq Core. Reads were trimmed with Trimmomatic and aligned to the genome using BWA. A base quality score recalibration and indel realignment was performed using GATK and SNP calling was done using two separate programs, GATK and LoFreq on the 20 bp gRNA homologous region. A true induced mutation was considered possible if the fraction of reads with a given variant was substantially higher than error rate of base calling.

TABLE 7

Top potential off target sites as determined by COSMID

| Name | Genomic location (hg19) |
|---|---|
| 44C4_OT1 | Chr11: 87808333-87808355 |
| 44C4_OT2 | Chr3: 160301263-160301285 |
| 44C4_OT3 | Chr4: 168882168-168882190 |
| 44C4_OT4 | Chr11: 12974242-12974264 |
| 44C4_OT5 | Chr11: 28401278-28401300 |
| 44C4_OT6 | Chr11: 96681660-96681682 |
| 44C4_OT7 | ChrX: 44266358-44266380 |
| 44C4_OT8 | Chr6: 75606852-75606874 |
| 44C4_OT9 | Chr1: 91110525-91110547 |
| 44C4_OT10 | Chr3: 145258890-145258912 |
| 55C3_OT1 | Chr18: 31956684-31956706 |
| 55C3_OT2 | Chr2: 28730131-28730153 |
| 55C3_OT3 | Chr10: 4923833-4923855 |
| 55C3_OT4 | Chr13: 68797419-68797440 |
| 55C3_OT5 | Chr13: 70672235-70672256 |
| 55C3_OT6 | Chr4: 101494350-101494372 |
| 55C3_OT7 | Chr3: 81046407-81046428 |
| 55C3_OT8 | Chr11: 45856883-45856904 |
| 55C3_OT9 | Chr1: 171162826-171162847 |
| 55C3_OT10 | Chr3: 108717117-108717140 |

Statistical Analysis

Statistical analyses were performed using a two-tailed t-test on two groups of data. First an F-test was used to determine if the variances were equal or unequal, than the corresponding t-test was used. Significance was determined by a p-value less than 0.05.

Example 1: A Single CRISPR-Cas9 Deletion Strategy that Targets the Majority of DMD Patients Restores Dystrophin Function in hiPSC-Derived Muscle Cells Mutations in DMD disrupt the reading frame, prevent dystrophin translation, and cause Duchenne muscular dystrophy (DMD). A CRISPR/Cas9 platform applicable to 60% of DMD patient mutations is described. The platform was applied to DMD-derived hiPSCs where successful deletion and non-homologous end joining of up to 725 kb reframed the DMD gene. Use of hiPSCs allowed for evaluation of dystrophin in disease relevant cell types. Cardiomyocytes and skeletal muscle myotubes derived from reframed hiPSC clonal lines had restored dystrophin protein. The internally deleted dystrophin was functional as demonstrated by improved membrane integrity and restoration of the dystrophin glycoprotein complex in vitro and in vivo. Furthermore, miR31 was reduced upon reframing, similar to observations in Becker muscular dystrophy.

DMD hiPSC Lines are Pluripotent and Genetically Stable

Several xenobiotic-free hiPSC lines derived from wild type and DMD patient fibroblasts were developed using current good manufacturing practice protocols. Each DMD hiPSC line harbors a unique frame-shifting DMD mutation within the exon 45-55 hotspot region. All hiPSC lines (Center for Duchenne Muscular Dystrophy (CDMD) 1003, 1006 and 1008) express pluripotency markers (NANOG and SOX2) and are karyotypically normal (FIG. 1A and FIG. 1B). CDMD hiPSCs maintain pluripotency, as they form teratomas in vivo that represent all three germ layers (FIG. 1C), and each harbor unique mutations (FIG. 1D).

FIG. 1: CDMD hiPSCs are pluripotent and genetically stable. FIG. 1A. CDMD hiPSCs were generated from DMD fibroblasts. Brightfield images depict fibroblasts before and after reprogramming to hiPSCs Immunocytochemical staining reveals that cells express pluripotency markers NANOG (green) and SOX2 (red). Scale bar 100 tim. FIG. 1B. Karyotyping of all lines is shown. FIG. 1C. CDMD hiPSCs were injected into mice to test teratoma formation in vivo. Representative hematoxylin and eosin stainings of the three germ layers (endoderm, mesoderm, and ectoderm) are shown. FIG. 1D. Patient mutations for each CDMD hiPSC line are shown. In addition, the number of exons and the approximate distance necessary for successful NHEJ is indicated, based on comparative genomic hybridization data for the patient's underlying mutation size.

CRISPR/Cas9-Mediated Deletion and NHEJ of Up to 725 kb in the DMD Gene

Figure 2A:
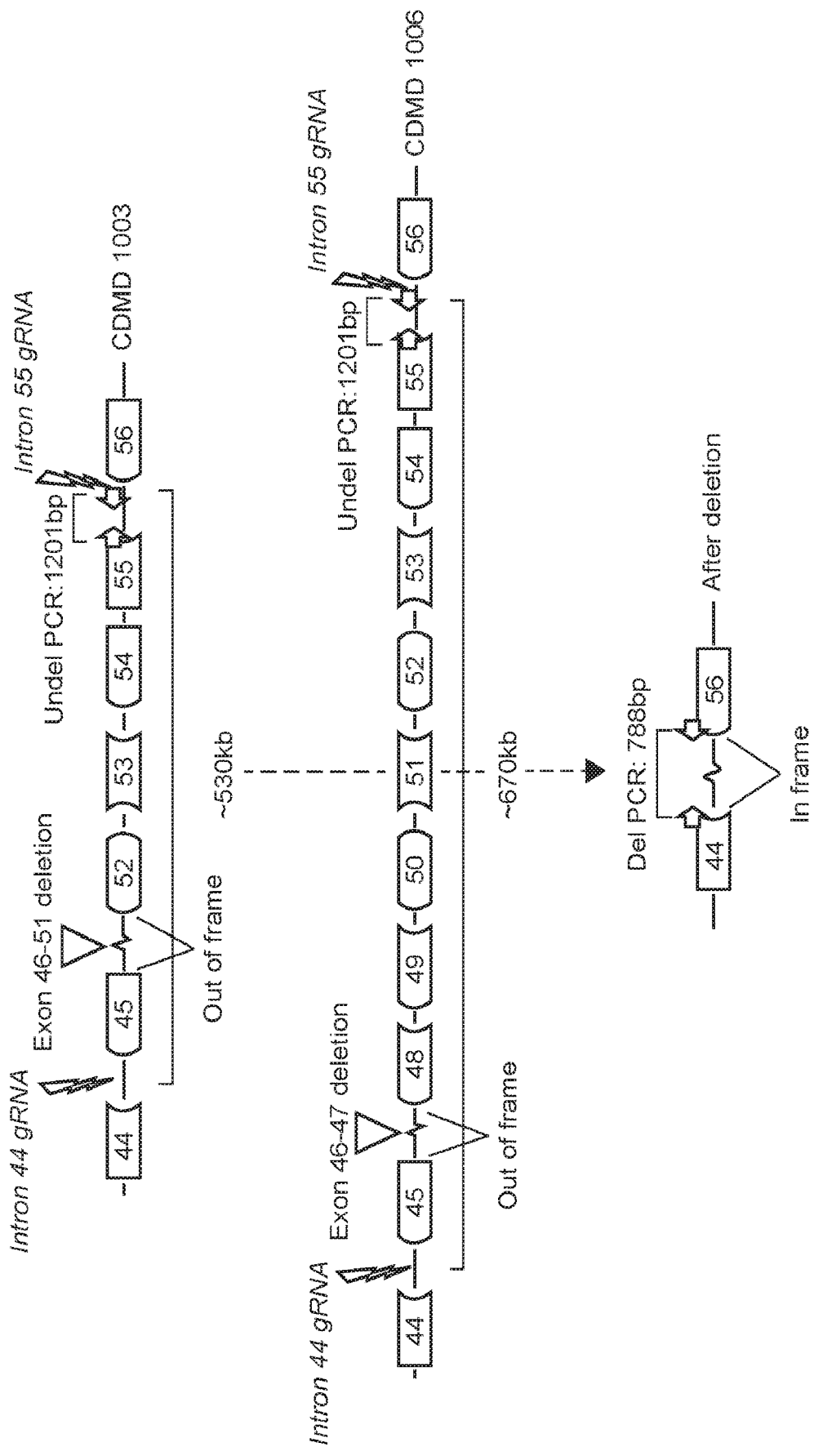

In order to delete exons 45-55 of DMD, gRNAs were designed to target introns 44 and 55. gRNA sites were chosen to only retain ~500 bp of the intron next to each of the flanking exons (44 and 56). The rationale for this design was to develop gRNAs applicable to as many patient mutations as possible and to ensure a small functional chimeric intron is generated. During NHEJ, the 3' end of intron 44 and the 5' end of intron 55 join to create a ~1 kb chimeric intron (FIG. 2A). Introns generated in this manner are expected to be functional and splice correctly to create an in-frame transcript, with exon 44 joined with exon 56.

FIG. 2: Generation of stable, pluripotent CDMD hiPSC lines with an exon 45-55 deletion. FIG. 2A. Shown is a cartoon (not to scale) of the region of DMD targeted for CRISPR/Cas9-mediated deletion using gRNAs specific to introns 44 and 55 (lightning bolts). Successful NHEJ deletes exons 45-55 and restores the reading frame for mutations within this region. Different deletion sizes are required depending on the patient's underlying mutation (black arrow heads). FIG. 2B. PCR genotyping of 117 and 109 single cell clones from parental lines CDMD 1006 and 1003, respectively, was carried out on cells nucleofected with gRNAs 44C4 and 55C3. One clone from CDMD 1006 (CDMD 1006-1) and three from CDMD 1003 (CDMD 1003-49, 1003-57, 1003-81) were identified as stably deleted. Deletion PCR genotyping results for 6 hiPSC clonal lines is shown. One pair of primers (red arrows in A) was located internal to the deletion and only produced a 1201 bp band in the undeleted clones CDMD 1003-13 and 1003-51. Another primer set (purple arrows in A) flanked the deletion region and produced a 788 bp band only when the deletion and NHEJ occurred successfully, as in the reframed clones CDMD 1006-1, 1003-49, 1003-57, 1003-81. FIG. 2C. Each clonal line maintained normal morphology (brightfield) and expressed NANOG (green) and SOX2 (red) by immunocytochemistry. Scale bar 100 μm. Shown to the right is the sequence of the gDNA at the rejoining site between introns 44 (144) and 55 (155). Sequencing revealed a 16 bp deletion in CDMD 1006-1, a 2 bp insertion in CDMD 1003-49, and 1 bp insertions in CDMD 1003-57 and CDMD 1003-81.

Figure 3A:
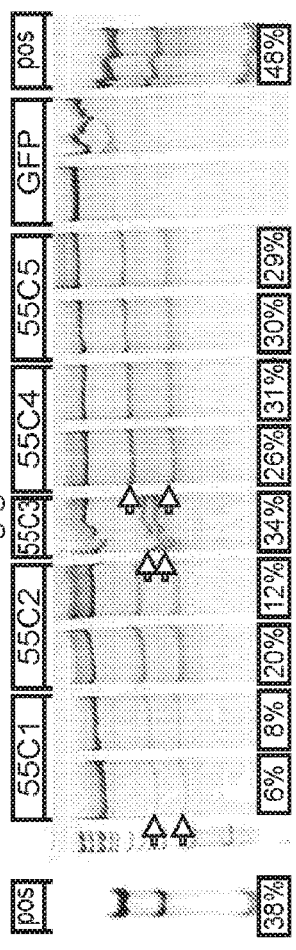
FIGS. 3A-3D depict gRNA activity and exon 45-55 deletion in 293FT cells.
Figure 3B:
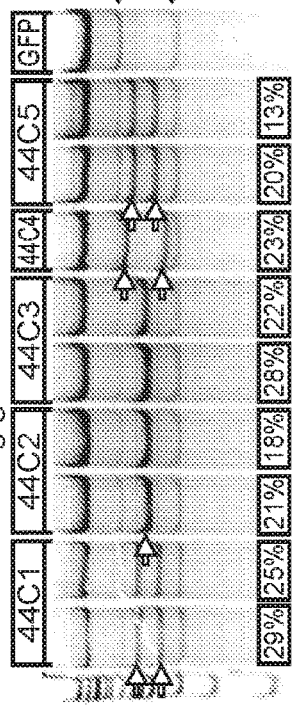
Figure 3C:
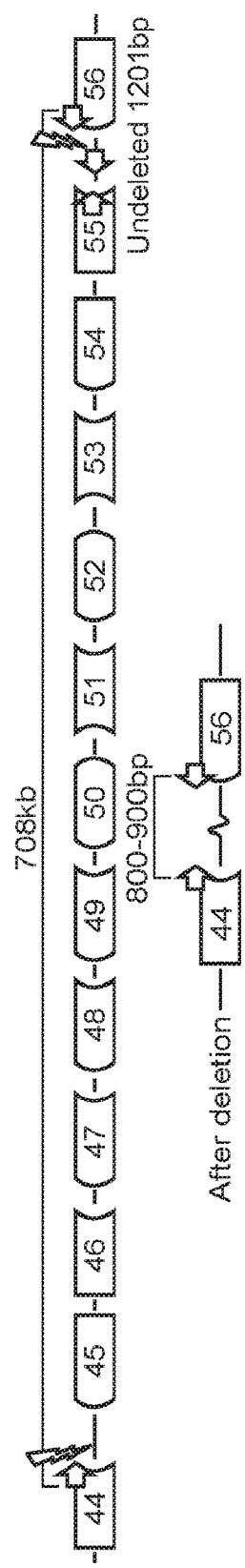
Figure 3D:
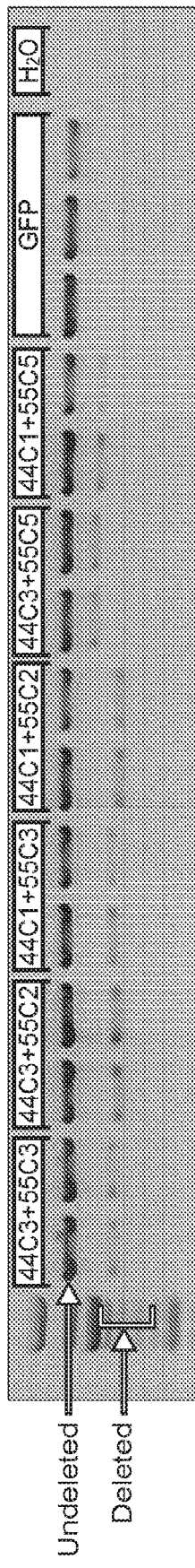

Since hiPSCs are challenging to genetically manipulate, human embryonic kidney (HEK) 293FT cells were used to screen five gRNAs at each intronic region. All gRNAs demonstrated individual cutting activity on Surveyor assay up to 34% (FIG. 3A and FIG. 3B). Using multiplex PCR, gRNAs transfected in pairs were shown to effectively delete the entire 708 kb region encompassing exons 45-55 (FIG. 3C and FIG. 3D).

FIG. 3: gRNA activity and exon 45-55 deletion in 293FT cells. FIG. 3A-3B. Five gRNAs targeted to introns 44 and 55 respectively, show activity on Surveyor assay in HEK293FT cells. Red arrows denote expected cleavage product bands (TABLE 8). Note in A, the bands highlighted by the blue arrowheads are likely non-specific PCR products and were discounted from the analysis. The estimated percent of cutting is shown below each lane. The positive control (pos) is provided with the Surveyor kit. A 100 bp ladder was used. FIG. 3C. Cartoon highlighting the region of DNA targeted by CRISPR pairs and indicating primers used for PCR. CRISPR gRNA sites are shown by lightning bolts. When pairs of gRNAs targeted to introns 44 and 55 are co-transfected, an exon 45-55 deletion (~708 kb) results after NHEJ. This deletion is measured using multiplex PCR where the primer pair shown in red will amplify the undeleted product while the purple primer pair flanking the deleted region only gives a product when successful rejoining has occurred. FIG. 3D. Example of a multiplex PCR, using the primers indicated in FIG. 3C, in which effective deletion of exons 45-55 was achieved with all gRNA pairs tested in 293FT cells. A 100 bp ladder was used.

TABLE 8

Expected cleavage product sizes from Surveyor assay

| gRNA | Expected sizes (bp) |
|---|---|
| 44C1 | 423, 480 |
| 44C2 | 445, 458 |
| 44C3 | 449, 454 |
| 44C4 | 387, 516 |
| 44C5 | 419, 484 |
| 55C1 | 379, 490 |
| 55C2 | 364, 505 |
| 55C3 | 411, 458 |
| 55C4 | 357, 512 |
| 55C5 | 351, 518 |

In order to assess the feasibility of an exon 45-55 deletion across different patient mutations, gRNAs were applied to three DMD hiPSC lines. The lines (CDMD 1003, 1006, 1008) required ~530 kb, 670 kb, or 725 kb for successful deletion and NHEJ of DMD respectively. The gRNAs used were shown to be active in all three lines and effectively deleted exons 45-55 (FIG. 4 and FIG. 5). Transient puromycin selection of cells nucleofected with the CRISPR plasmids improved the efficiency of deletion in CDMD 1003 and 1006 hiPSCs (FIG. 5D).

FIG. 4: gRNAs show cutting by Surveyor assay in CDMD hiPSCs. FIG. 4A. CDMD 1006 hiPSCs nucleofected with GFP serve as an untreated control and demonstrate ~40% transfection efficiency. FIG. 4B-FIG. 4D. gRNAs demonstrate activity on Surveyor assay in CDMD 1003, 1006 and 1008 lines respectively. *3× the amount of 55C3 DNA was added during nucleofection. Red arrows denote expected cleavage product bands (TABLE 8). Note the band in FIG. 4B highlighted by the blue arrow head is likely a non-specific PCR product and was discounted from analysis. The estimated percent of cutting is shown below each lane. A 100 bp ladder was used.

FIG. 5: Nucleofection of paired gRNAs results in an exon 45-55 deletion in CDMD hiPSCs. FIG. 5A. PCR using primers flanking the deleted region show bands for successful deletion and rejoining after nucleofection of a variety of CRISPR pairs in hiPSC CDMD 1006. A 100 bp ladder was used. FIG. 5B. Examples of the types of different rejoined products identified after sequencing. FIG. 5C. The sequencing for 44C4+55C3* seamless rejoining is shown. FIG. 5D. Multiplex PCR shows an exon 45-55 deletion product in all lines nucleofected with 44C4 and 55C3 gRNAs. A significant increase in the efficiency of deletion in CDMD 1006 and 1003 after selection with 0.35 µg/ml puromycin for one day is shown. *3× the amount of 55C3 DNA was added during nucleofection. A 100 bp ladder was used.

Figure 6A:
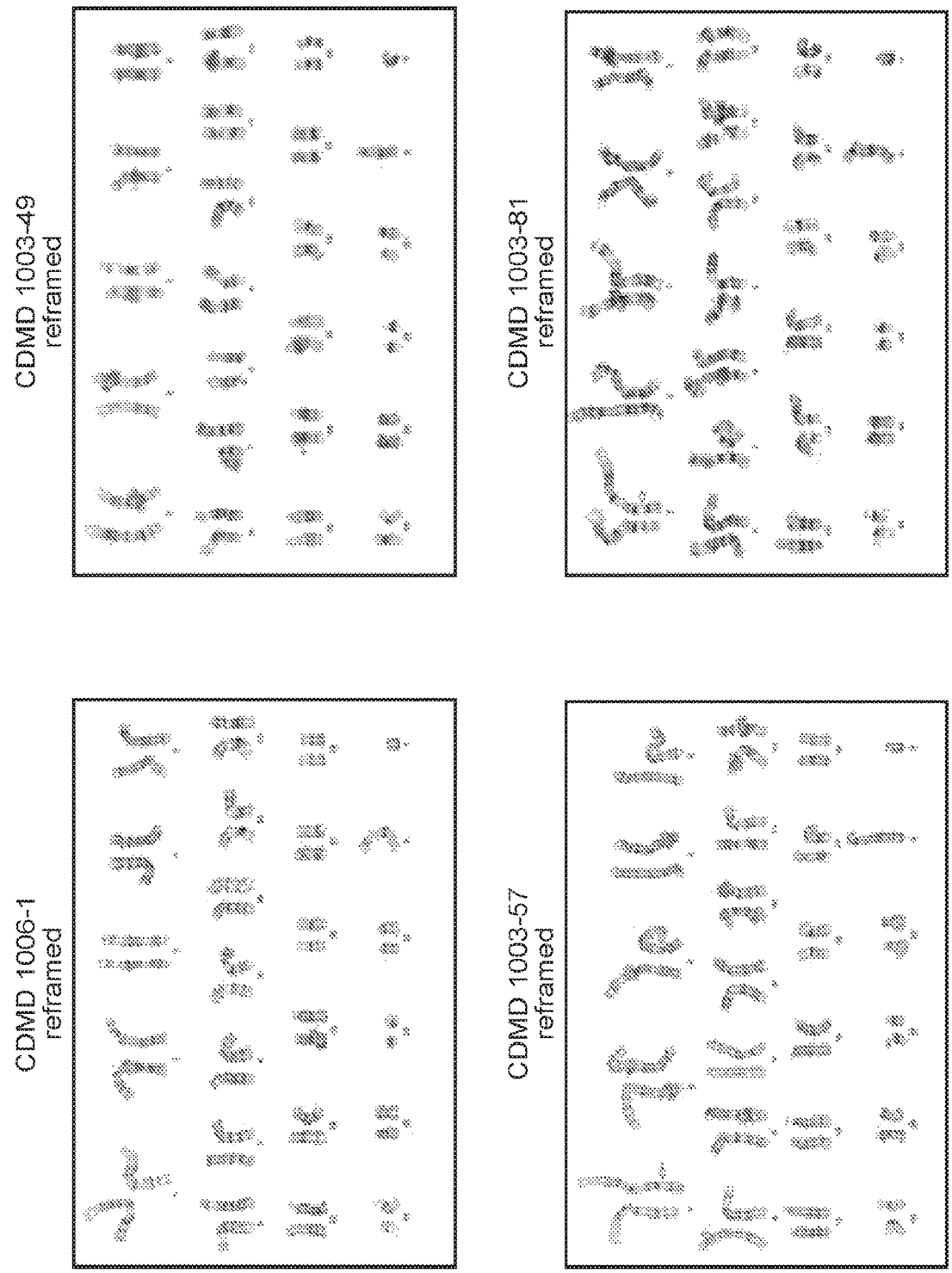
FIGS. 6A-6F depict the characterization of reframed CDMD hiPSC lines.
Figure 6B:
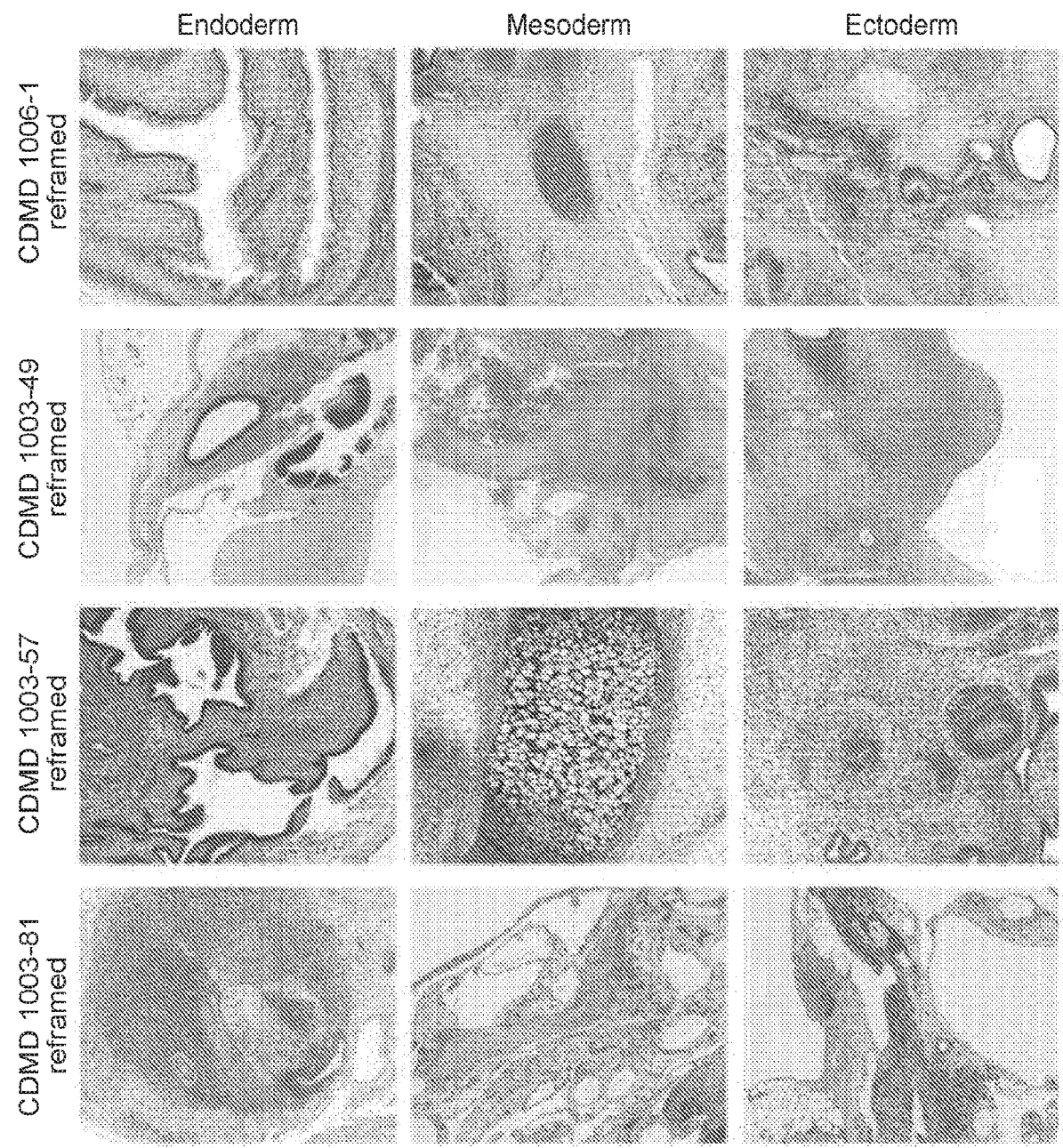

Clonal Reframed DMD hiPSC Lines Contain No Off Target Activity at Candidate Sites Stably deleted DMD hiPSC lines were generated from CDMD 1003 and 1006 by clonal selection after nucleofection with the gRNA pair 44C4 and 55C3 (FIG. 2B and FIG. 2C) and are pluripotent (FIG. 2C and FIG. 6B). All reframed lines were karyotypically normal except for one clone (CDMD 1003-81), which was found to contain a 1q32 amplification confirmed via FISH analysis (FIG. 6A), also observed in the original parental line and in all daughter clones after post-hoc analysis. The 1q32 amplification is common in hPSCs after extended propagation in culture (Dekel-Naftali et al., Eur. J. Hum. Genet., 2012. 20:1248-1255), and thus was not a result of CRISPR-mediated off target activity. To determine off target activity of the gRNAs, the top 10 homologous sites per guide were determined by COSMID (Cradick et al., Mol. Ther. Nucleic Acids, 2014. 3:e214) and sequenced in all clonal and parental lines. No off target mutations were observed at any site. All variants, besides a heterozygous SNP in chromosome 11, were detected in less than 1% of reads which is consistent with error in the sequencing method.

Figure 4A:
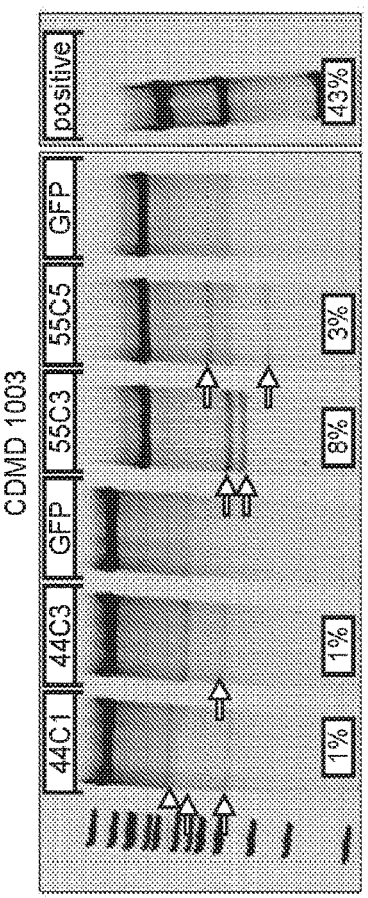
FIGS. 4A-4D depict gRNAs showing cutting by Surveyor assay in CDMD hiPSCs.
Figure 4B:
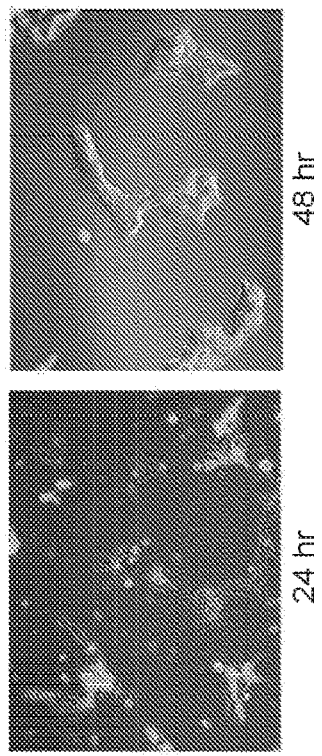
Figure 4C:
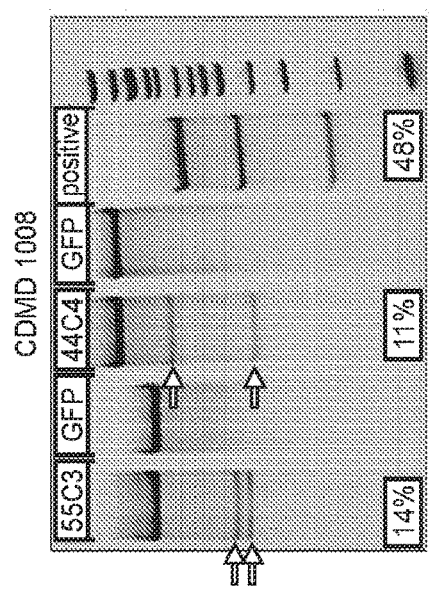
Figure 4D:
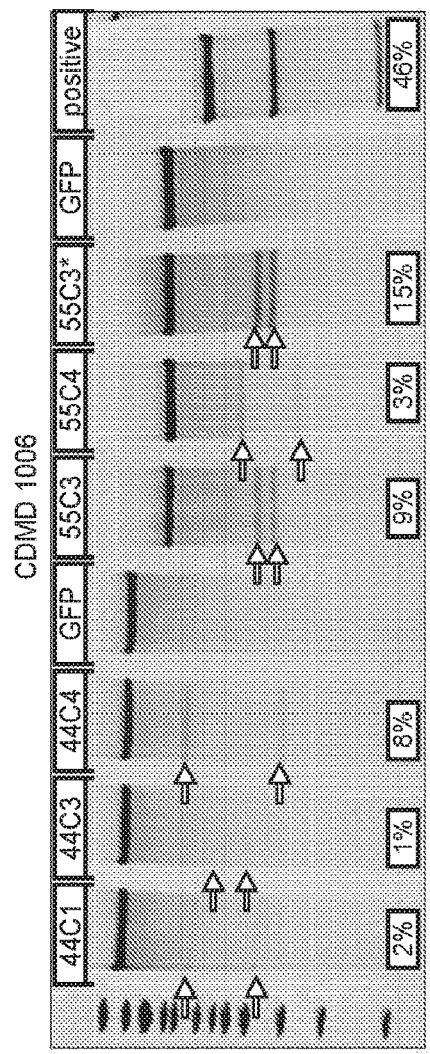

FIG. 6: Additional characterization of reframed lines. FIG. 6A. All reframed lines were determined to be karyotypically normal except for CDMD 1003-81, which was found to contain a 1q32 amplification via FISH analysis. Upon retrospective analysis, the 1q32 amplification was determined to have existed in the parent line (CDMD 1003 line at 22%) and was found in all daughter lines (CDMD 1003-57 and 1003-49 at 82.5%) and was not a result of CRISPR activity. FIG. 6B. Reframed lines CDMD 1006-1, 1003-49, 1003-57, and 1003-81 formed teratomas consisting of the three germ layers in vivo. FIG. 6C. Analysis of the mRNA from reframed lines. PCR using primers within the deleted region (red arrows) or flanking the deleted region (purple arrows) on dystrophin cDNA from hiPSC-derived cardiomyocytes shows undeleted bands in both CDMD 1002 and 1006 and deleted bands in both CDMD 1006-1 and 1003-49. A 100 bp ladder was used. FIG. 6D. Sequencing confirms exon 44 and 56 rejoining in reframed CDMD 1006-1 and 1003-49. FIG. 6E. Graph of data from CK release assay of hiPSC-derived cardiomyocytes exposed to hypoosmotic conditions below 240 mosmol. The same CDMD 1002 control data as in FIG. 4A are shown. Data are presented as average±standard error. FIG. 6F. CK release assay data normalized to out-of-frame cells and pooled from all experiments shown (n=6 for out-of-frame and reframed (n=5 for reframed 135 mosmol), n=4 for wild type). Data are presented as average±standard error.

Figure 6C:
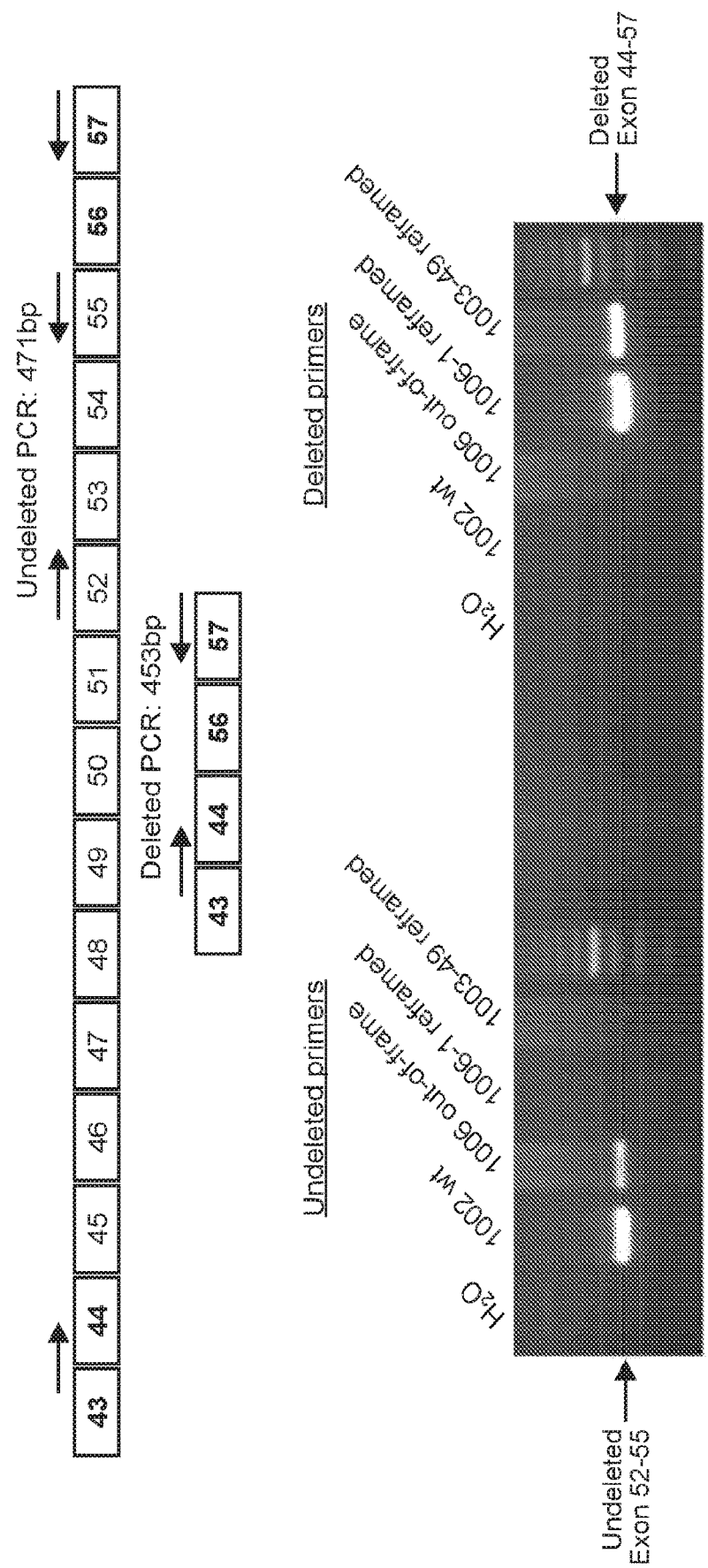
Figure 6D:
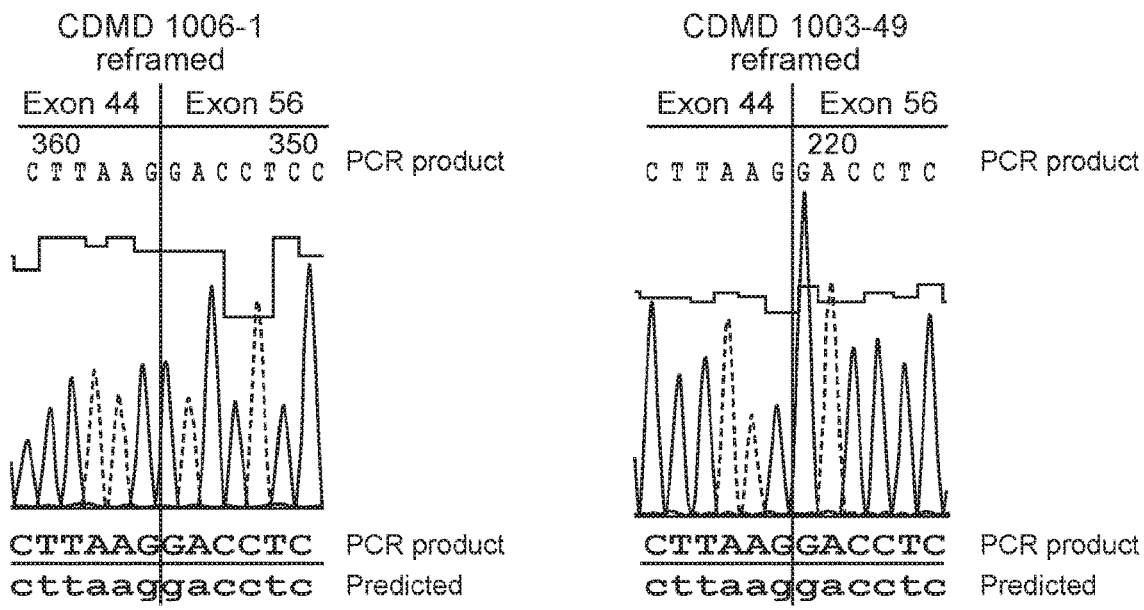
Figure 7A:
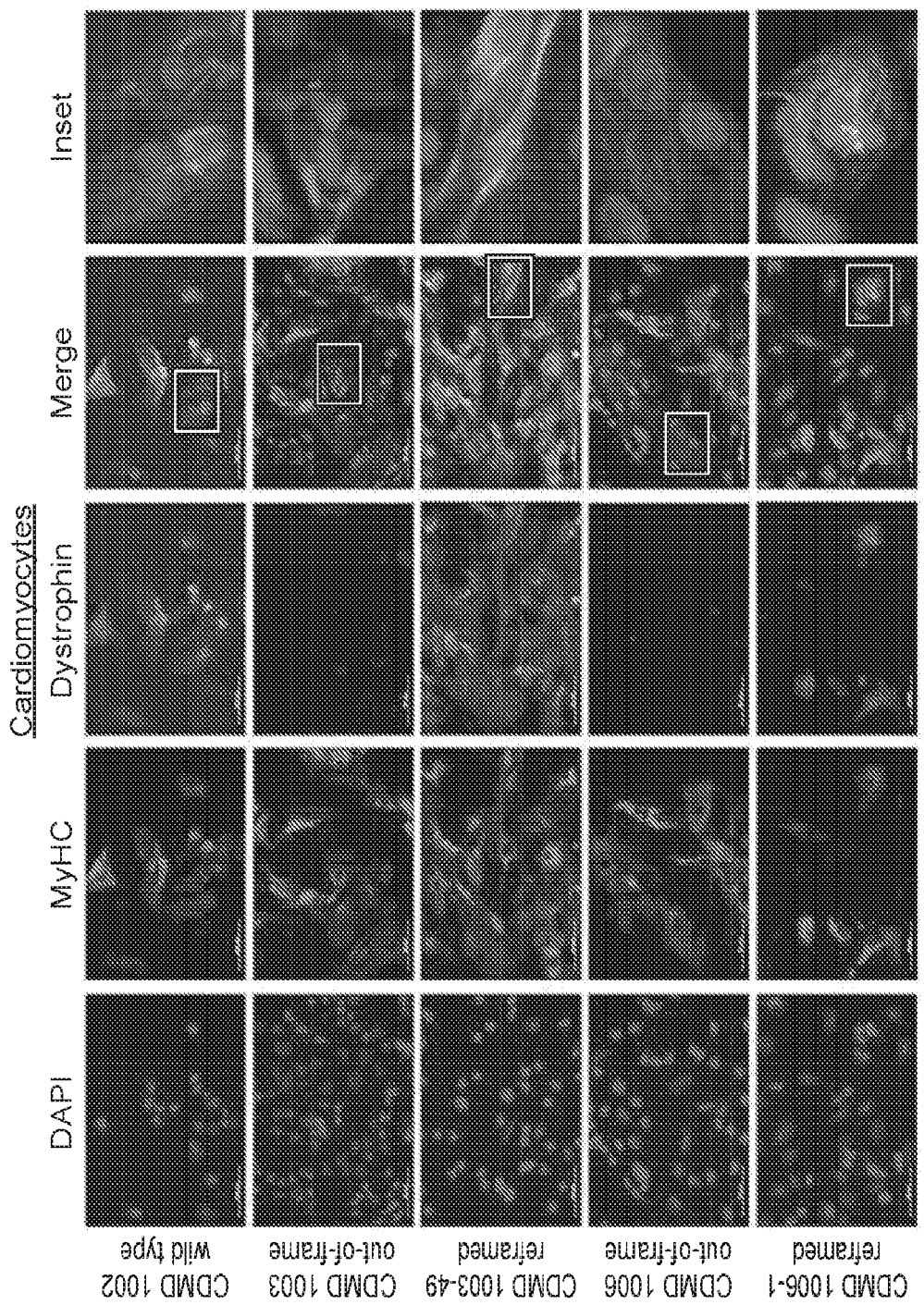
FIGS. 7A-7C depict dystrophin expression in reframed CDMD hiPSC-derived cardiomyocytes and skeletal muscle cells.
Figure 7B:
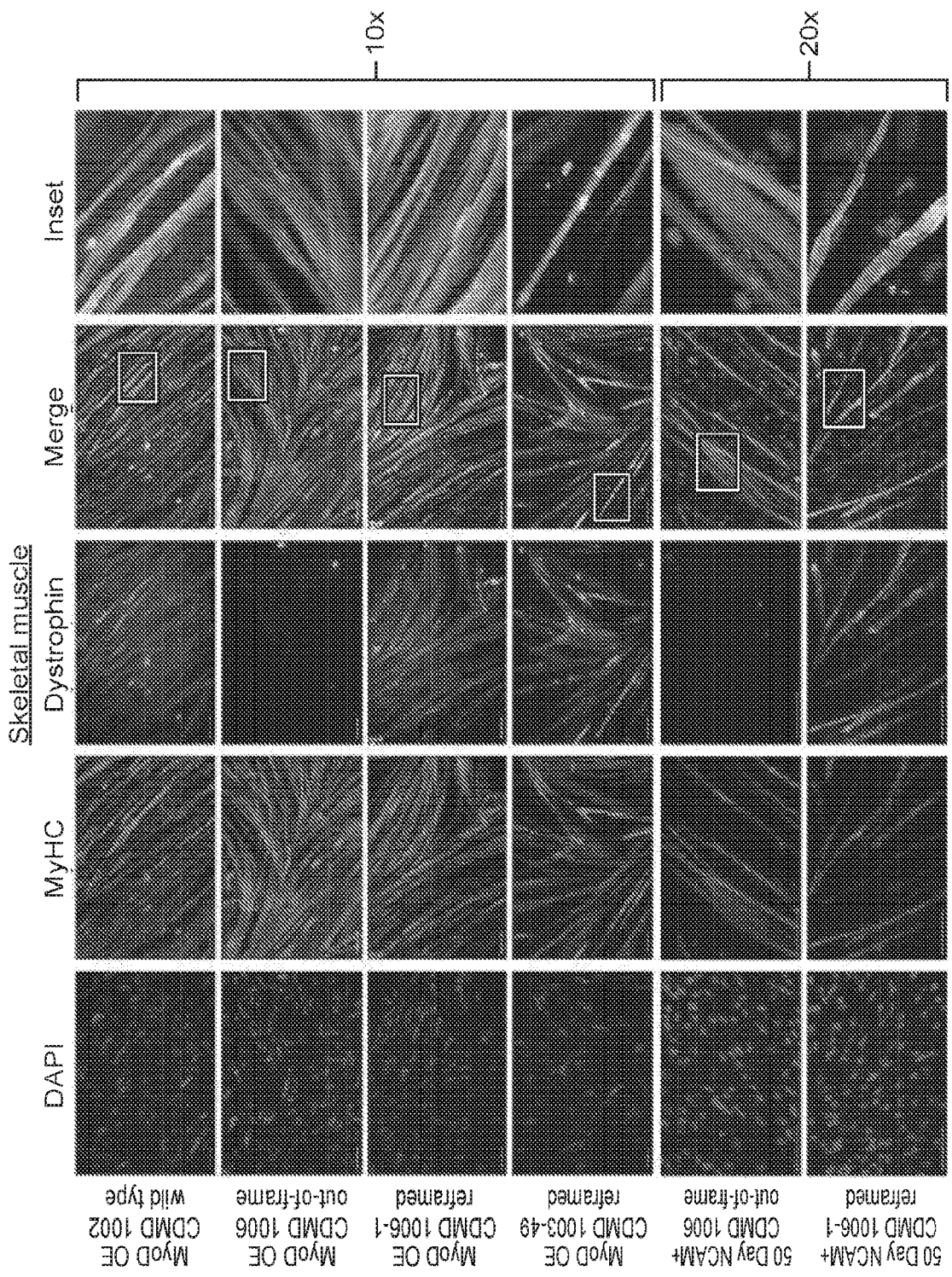
Figure 7C:
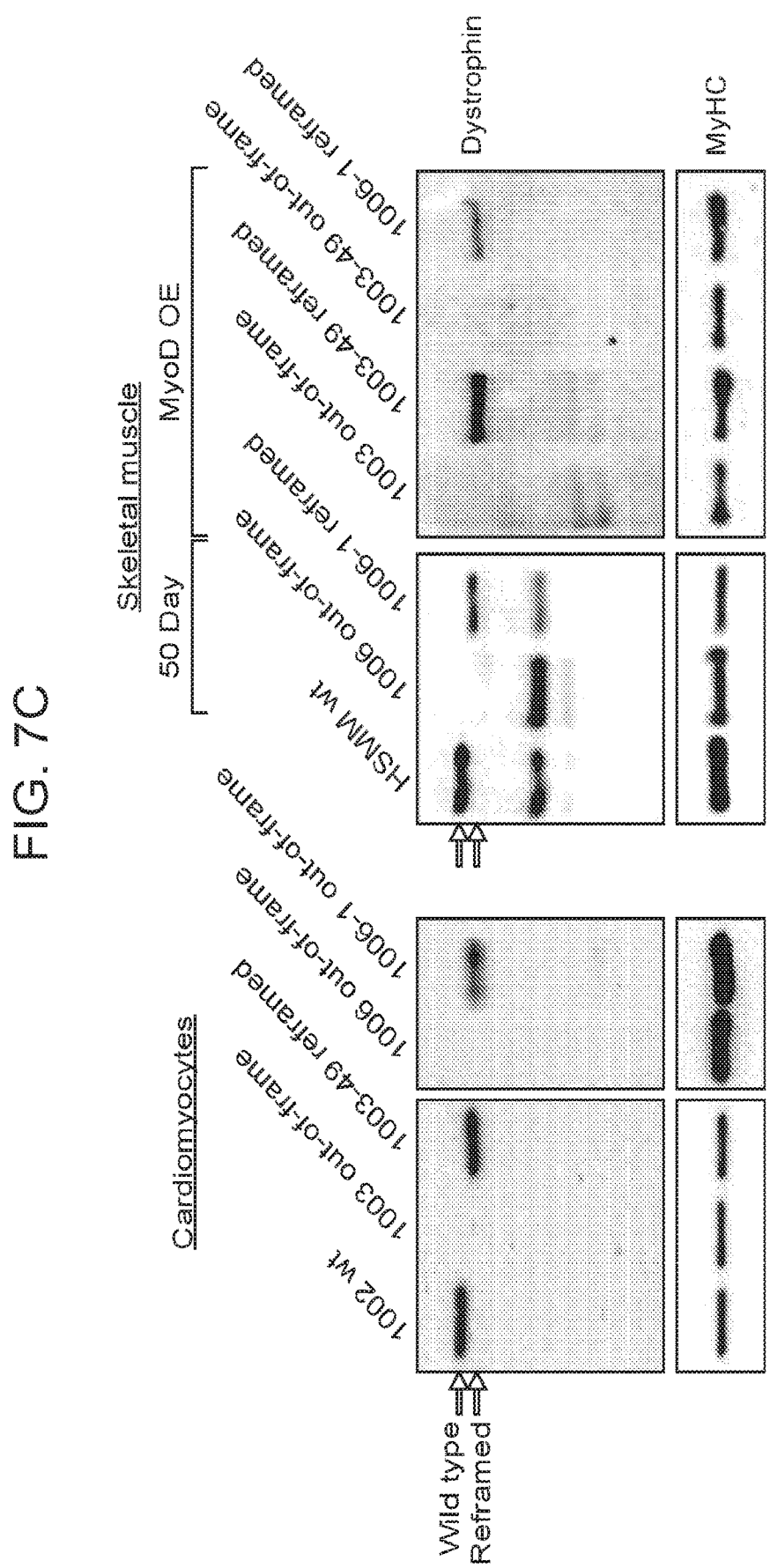

Dystrophin ($DYS^{\Delta 45-55}$) Expression is Restored in Reframed DMD hiPSC-Derived Cardiomyocytes and Skeletal Myotubes CRISPR/Cas9-mediated deletion of DMD should result in an internally deleted dystrophin protein lacking exons 45-55 (hereafter referred to as $DYS^{\Delta 45-55}$). As hiPSCs do not express dystrophin, the reframed DMD hiPSC clonal lines were differentiated to two disease-relevant cell types, cardiomyocytes and skeletal muscle myotubes, using directed differentiation or overexpression of MyoD to evaluate rescue of $DYS^{\Delta 45-55}$. PCR and sequencing of the exon 44/56 boundary in cDNA from the reframed cardiomyocyte clones demonstrated correct splicing of the dystrophin transcript (FIG. 6C and FIG. 6D). Additionally, both the reframed cardiac and skeletal muscle cell lines restored dystrophin expression as assayed by immunocytochemistry and Western blot (FIG. 7A-FIG. 7C). Compared to wild type CDMD 1002 or human skeletal muscle myotubes (HSMM), the band was truncated by ~66 kDa as expected.

FIG. 7: Reframed CDMD hiPSC-derived skeletal muscle and cardiomyocytes restore dystrophin expression. FIG. 7A Immunocytochemical staining of human myosin heavy chain (MyHC, red) and dystrophin (green) of wild type (CDMD 1002), out-of-frame (CDMD 1003, 1006) or reframed (CDMD 1003-49, 1006-1) cardiomyocytes derived from hiPSCs by directed differentiation. Inset depicts zoomed in region defined by the white box. Scale bar 50 tim. FIG. 7B Immunocytochemical staining of MyHC (red) and dystrophin (green) of wild type (CDMD 1002), out-of-frame (CDMD 1006) or reframed (CDMD 1006-1, 1003-49) skeletal muscle myotubes derived from hiPSCs. Myotubes were fused after MyoD overexpression (OE) or from sorted NCAM$^+$ cells after an adapted directed differentiation 50-day protocol. Inset depicts zoomed in region defined by the white box. Scale bar 100 tim. FIG. 7C. Western blots of cell extracts probed with anti-dystrophin. Extracts were from out-of-frame and reframed cardiomyocytes (left) and skeletal muscle myotubes (right), derived from CDMD hiPSCs. Wild type (wt) hiPSCs (CDMD 1002) or human skeletal muscle myotubes (HSMM) were used as a control for dystrophin. The molecular weight shift caused by the exon 45-55 deletion (1779 bp, ~66 kDa) is evident in reframed vs. wild type dystrophin (arrows). A non-specific band around 220 kDa was seen in some samples. Samples were also probed with anti-MyHC as a loading control (bottom panels).

Figure 6E:
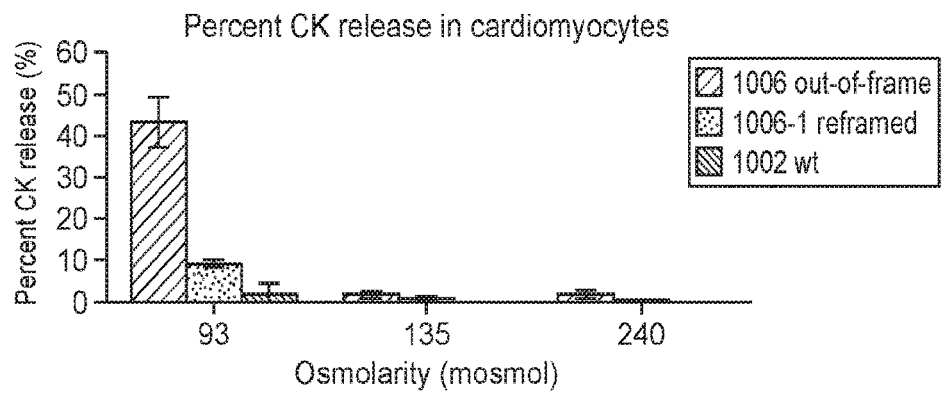
Figure 6F:
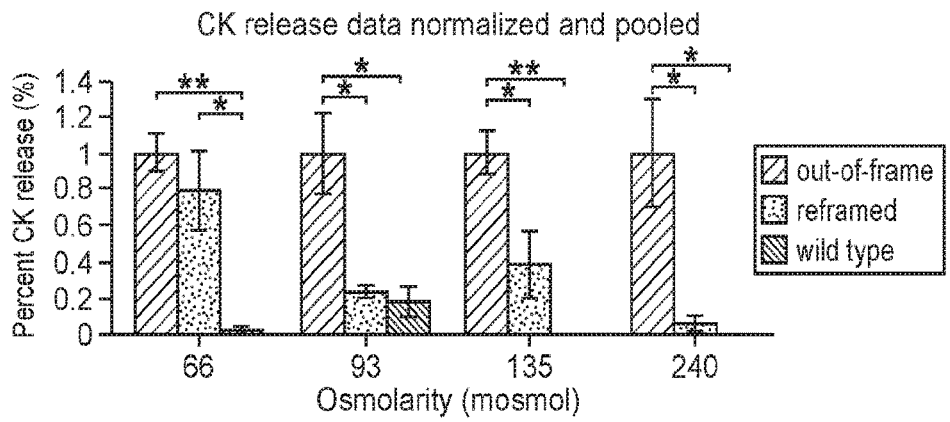

DYS$^{\Delta 45-55}$ Protein Restores Membrane Functionality to Cardiomyocytes and Skeletal Myotubes In Vitro Cardiomyocytes or skeletal myotubes lacking dystrophin demonstrate membrane fragility in vitro and respond to osmotic stress by releasing elevated levels of CK (Guan et al., Stem Cell Res., 2014. 12:467-480; Menke and Jockusch, J. Cell Sci., 1995. 108:727-733), as is seen in human patients (Pearce et al., J. Neurol. Neurosurg. Psychiatry, 1964. 27:181-185). To determine whether DYS$^{\Delta 45-55}$ could restore stability to dystrophic plasma membranes, differentiated cardiomyocytes and skeletal muscle myotubes derived from reframed and out-of-frame hiPSCs were subjected to hypoosmotic conditions. Cells were stressed by incubation in hypoosmolar solutions (66-240 mosmol) and CK release into the supernatant was measured to show functional improvement after dystrophin restoration. Both the reframed CDMD 1003-49 cardiomyocytes and skeletal muscle cells demonstrated reduced CK release, similar to wild type (CDMD 1002), versus the out-of-frame CDMD 1003 cells, indicating that DYS$^{\Delta 45-55}$ was capable of reducing membrane fragility (FIG. 8A). The same trend was also observed with CDMD 1006/1006-1 cardiomyocytes (FIG. 6E). After normalizing and pooling all experiments, it was observed that significantly less CK was released at 93, 135, and 240 mosmol in the reframed and wild type cells compared to out-of-frame (FIG. 6F).

FIG. 8: Reframed hiPSC-derived cardiomyocytes and skeletal muscle cells demonstrate restored function in vitro and in vivo. FIG. 8A. Representative graphs of CK release assays from cells exposed to hypoosmotic conditions. Cardiomyocytes and skeletal muscle myotubes derived from hiPSCs were subjected to a range of osmolarities below 240 mosmol and CK release to the supernatant was measured as an indication of membrane fragility. Data are presented as average±standard error. FIG. 8B. Fold change in expression of miR31 measured by ddPCR in myotubes derived from out-of-frame or reframed hiPSCs by MyoD OE, normalized to wild type (CDMD 1002). Data are presented as average±standard deviation. FIG. 8C. Western blots of cell extracts probed with anti-β-dystroglycan. Extracts were from out-of-frame and reframed skeletal muscle myotubes derived by MyoD OE. HSMM was used as a positive control. Samples were also probed with anti-MyHC as a loading control (bottom panel). FIG. 8D Immunocytochemical staining of MyHC (red) and β-dystroglycan (green), a component of the DGC, in wild type (CDMD 1002), out-of-frame (CDMD 1006) or reframed (CDMD 1006-1) skeletal muscle myotubes. Inset depicts zoomed in region defined by the white box. Scale bar 50 tim. FIG. 8E. Assessment of human dystrophin restoration in wild type (CDMD 1002), out-of-frame (CDMD 1003), and reframed (CDMD 1003-49) MyoD OE cells engrafted into the TA of NSG-mdx mice. Engrafted human cells were identified by co-immunostaining for human spectrin and lamin A/C (shown in red). Positive staining for human dystrophin is shown in green and all fibers are shown using laminin (grey). All sections were stained with DAPI (blue) to identify nuclei. Scale bar 100 tim. FIG. 8F. Assessment of β-dystroglycan restoration in human fibers from wild type (CDMD 1002), out-of-frame (CDMD 1003), and reframed (CDMD 1003-49) MyoD OE cells engrafted into the TA of NSG-mdx mice. Engrafted human cells were identified by co-immunostaining for human spectrin and lamin A/C (shown in red). Positive staining for dystrophin is shown in grey and β-dystroglycan is shown in green. All sections were stained with DAPI (blue) to identify nuclei. Cell order is same as noted in FIG. 8E. Scale bar 20 tim.

CRISPR/Cas9 Reframing Correlates with miR31 Levels in Skeletal Myotubes In Vitro Elevated levels of miR31 have been observed in DMD patient biopsies compared to wild type or BMD (Cacchiarelli et al., EMBO Rep., 2011. 12:136-141). Levels of miR31 were measured using droplet digital PCR (ddPCR) after differentiation of out-of-frame and reframed CDMD hiPSCs to skeletal myotubes. Reframing DMD reduced levels of miR31 (similar to wild type cells), compared to out-of-frame DMD, as is observed in human dystrophinopathies (FIG. 8B). Thus, reframing the DMD gene normalizes miR31 levels similar to BMD, demonstrating functional rescue of the dystrophic phenotype to a BMD phenotype.

DYS$^{\Delta 45-55}$ Protein Restores the DGC In Vitro and In Vivo

Figure 8C:
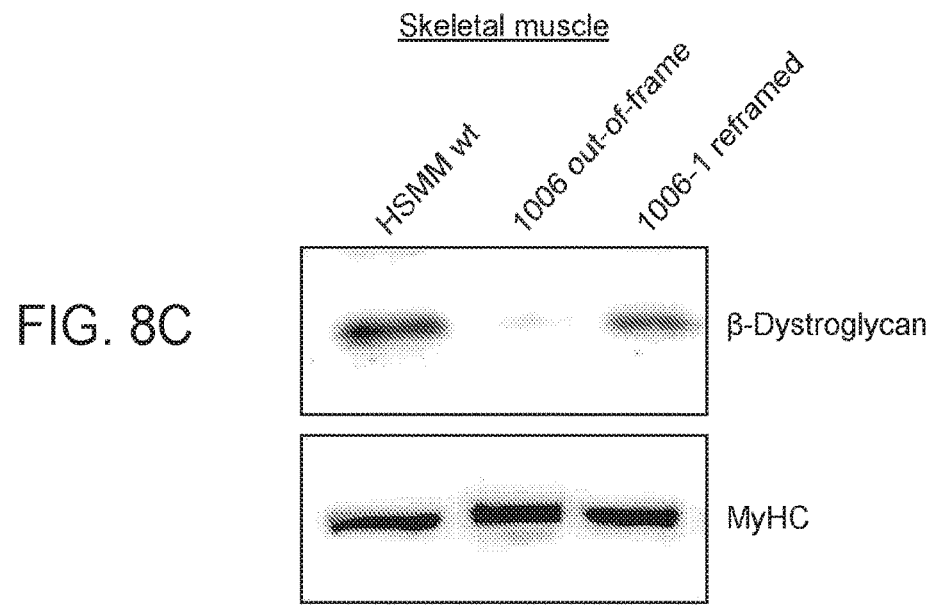
Figure 8D:
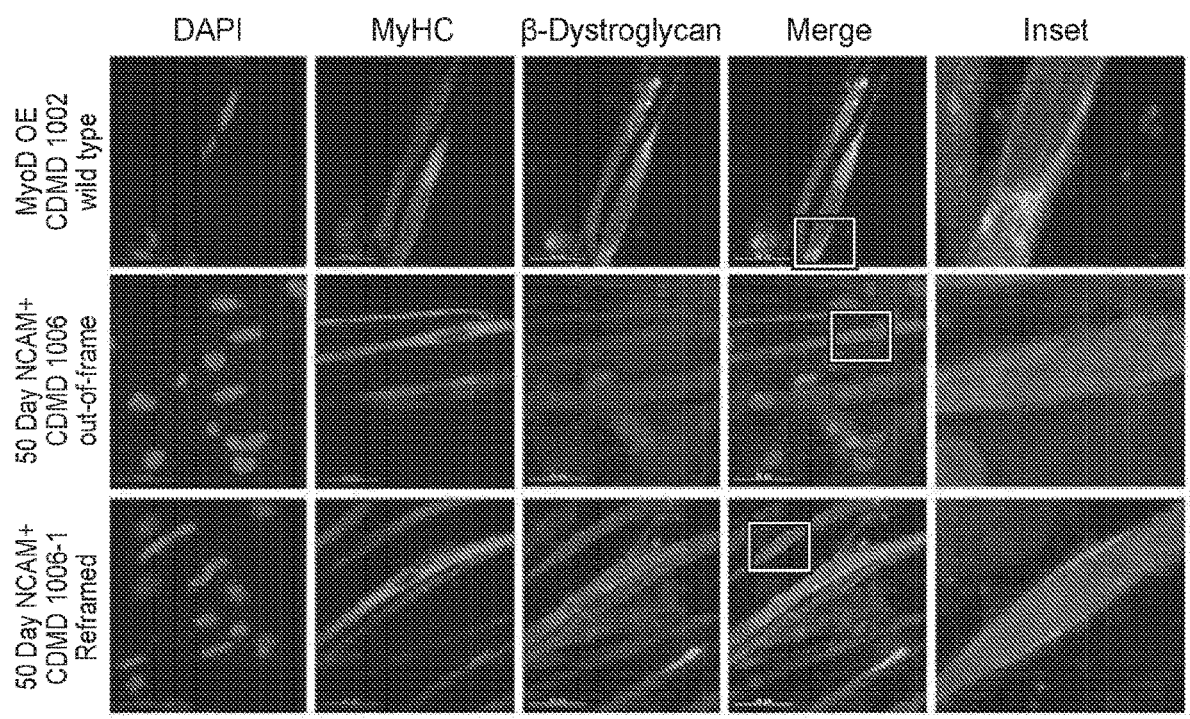
Figure 8E:
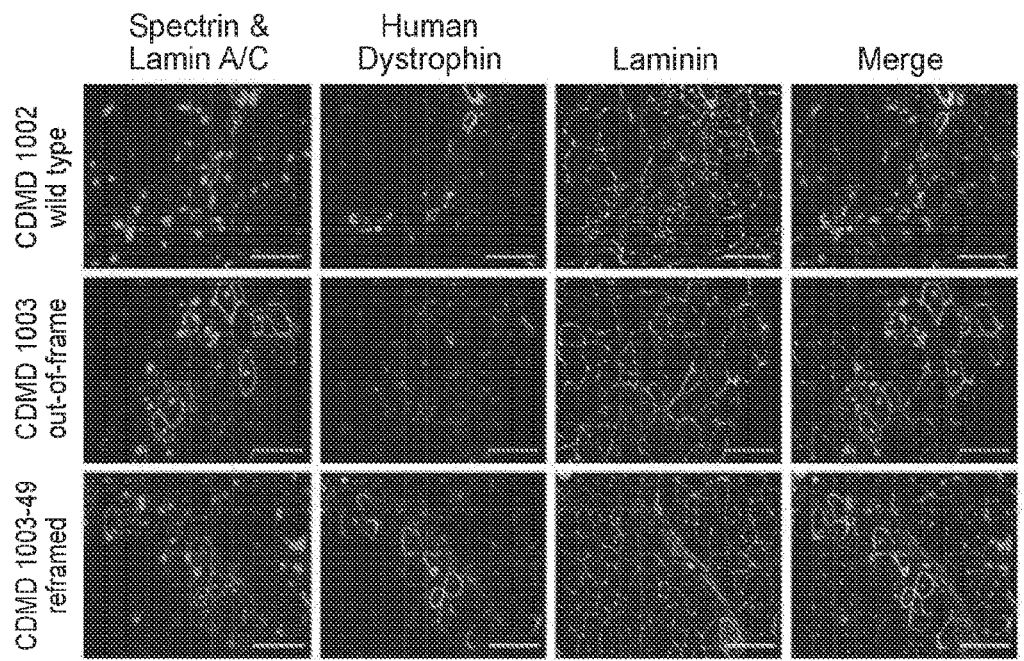
Figure 8F:
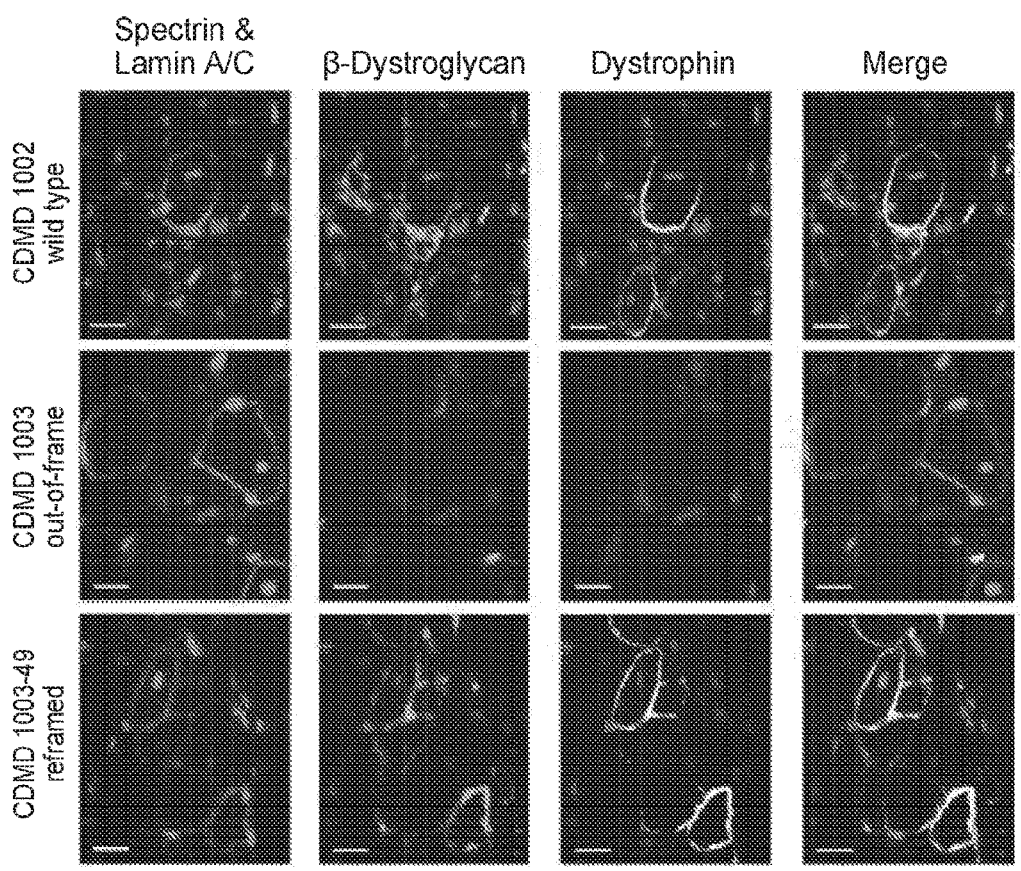

As a third assay of DYS$^{\Delta 45-55}$ functionality, its ability to restore the DGC in vitro and in vivo was evaluated. The DGC member, β-dystroglycan, was restored and detected at the membrane of reframed hiPSCs, but not out-of-frame hiPSCs, after directed differentiation to skeletal muscle in vitro by immunostaining and Western blot (FIG. 8C and FIG. 8D). Additionally, skeletal muscle cells derived from a wild type (CDMD 1002), out-of-frame (CDMD 1003), or reframed (CDMD 1003-49) hiPSC line were injected into the tibialis anterior of NSG-mdx mice. Correctly localized dystrophin and β-dystroglycan was only observed in engrafted human cells (demarked by human lamin A/C and spectrin) from the reframed or wild type lines (FIG. 8E and FIG. 8F). These studies taken together with the hypoosmotic stress assays demonstrate the ability of DYS$^{\Delta 45-55}$ to functionally reassemble the DGC and restore membrane stability in vitro and in vivo.

Example 2: In Vivo Electroporation of CRISPR Platform Results in Exon 45-55 Deletion in hDMD Mice hDMD mice were electroporated with the CRISPR platform and resulted in deletion of exon 45-55.

Figure 9A:
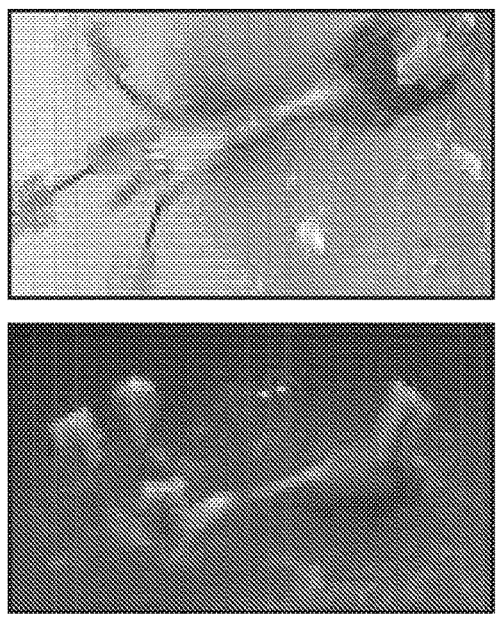
FIGS. 9A-9C depict the in vivo electroporation of CRISPR platform into hDMD mice.
Figure 9B:
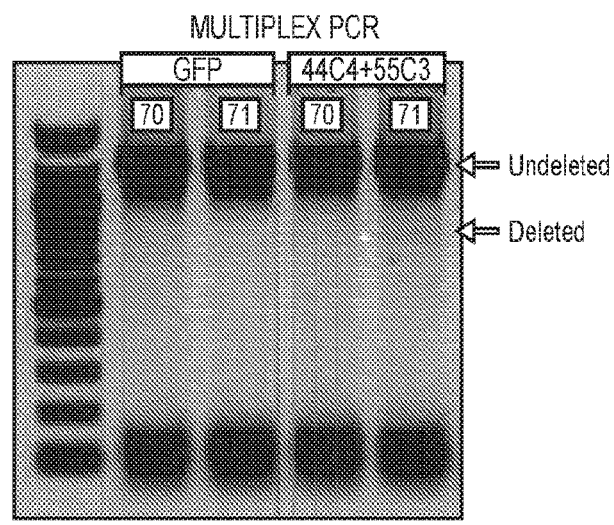
Figure 9C:
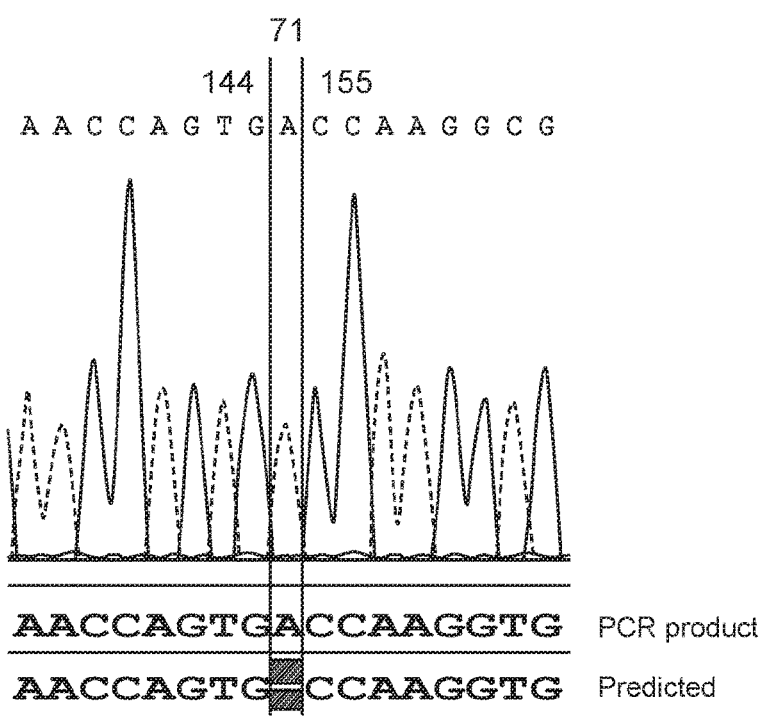

FIG. 9: FIG. 9A. hDMD mice electroporated with a GFP plasmid into one FDB muscle showed expression of GFP under regular (top) or UV (bottom) light. FIG. 9B. Multiplex PCR on genomic DNA harvested from the FDB muscle of hDMD mice electroporated with the CRISPR plasmids containing gRNAs 44C4 and 55C3 demonstrated a deleted PCR product in one mouse (*). FIG. 9C. Sequencing of the rejoining region confirmed effective exon 45-55 deletion and revealed a 1 bp insertion at the intron 44 (I44) and 55 (I55) boundary.

In vivo electroporation was conducted as follows. hDMD mice ('t Hoen et al. (2008) *J. Biol. Chem.* 283:5899) at 8 weeks of age were electroporated with 23 μg of pmax GFP plasmid as a control or 28 μg px330 plasmid DNA, half containing guide sequence 44C4 and half containing guide sequence 55C3. First, 5 μl hyaluronidase was injected into the flexor digitorum *brevis* (FDB) muscle. One hour after the hyaluronidase treatment, plasmid DNA was injected into the FDB muscle and electroporated 20 times at 100V for 20 milliseconds. 10 days following injection and electroporation, FDB muscle was harvested and digested with proteinase K; genomic DNA was isolated from the digested muscle using the Quick gDNA Mini Prep Kit (Zymo).

Figure 10:
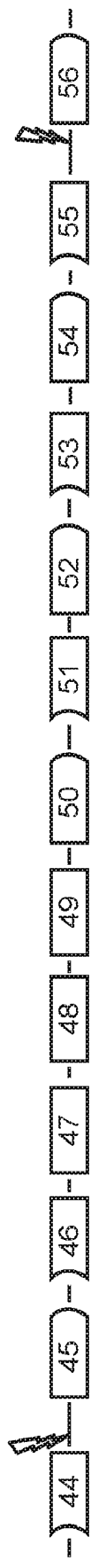
FIG. 10 depicts a schematic depiction of guide RNAs that were tested (e.g., see Table 2, provided in FIG. 23) and expected deletion size ('total deletion distance').
Figure 12:
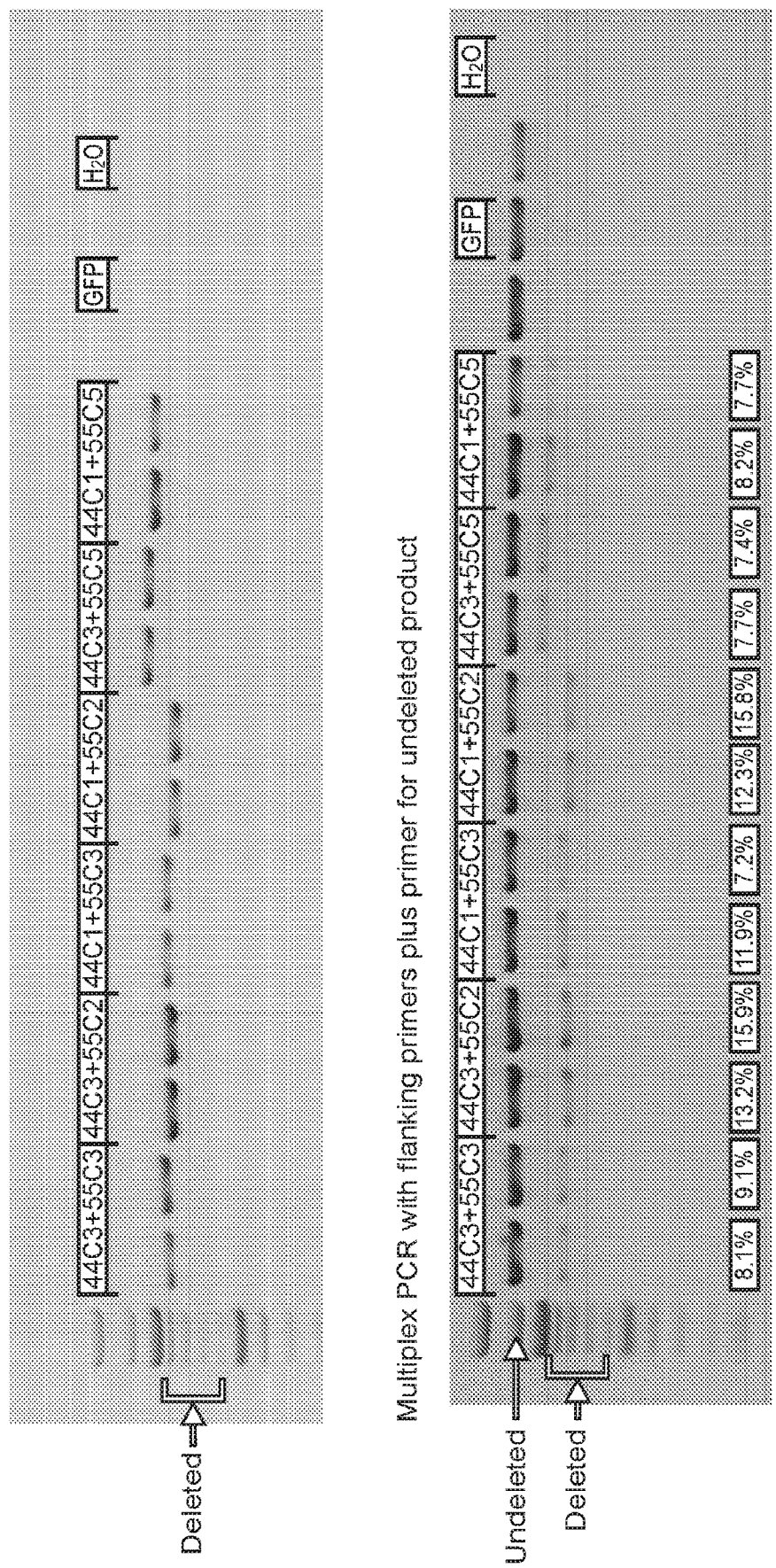
FIG. 12 depicts gels showing successful genomic deletion with various pairs of guide RNAs in 293T cells.
Figure 13:
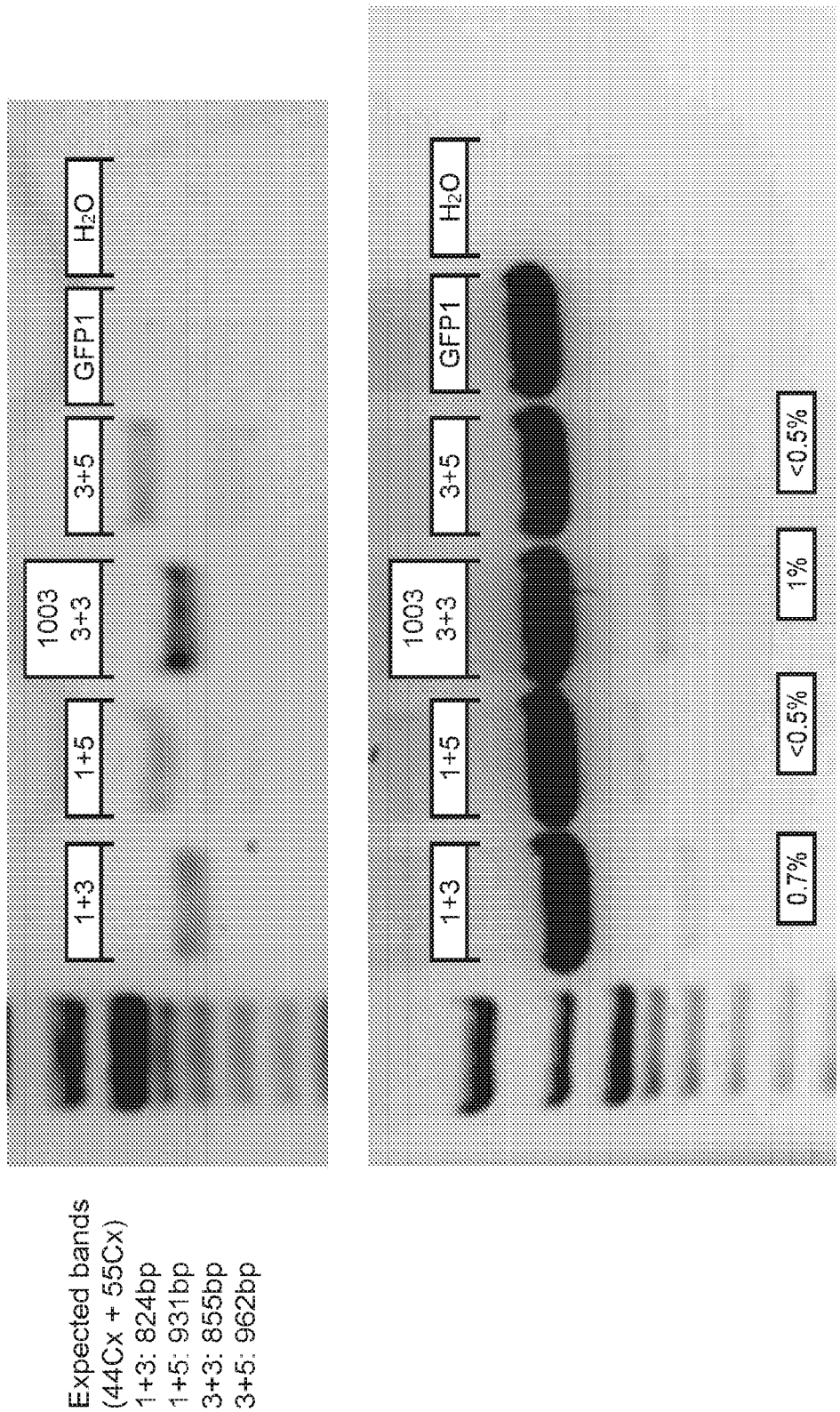
FIG. 13 depicts gels showing successful genomic deletion with various pairs of guide RNAs in iPSC cells.
Figure 14:
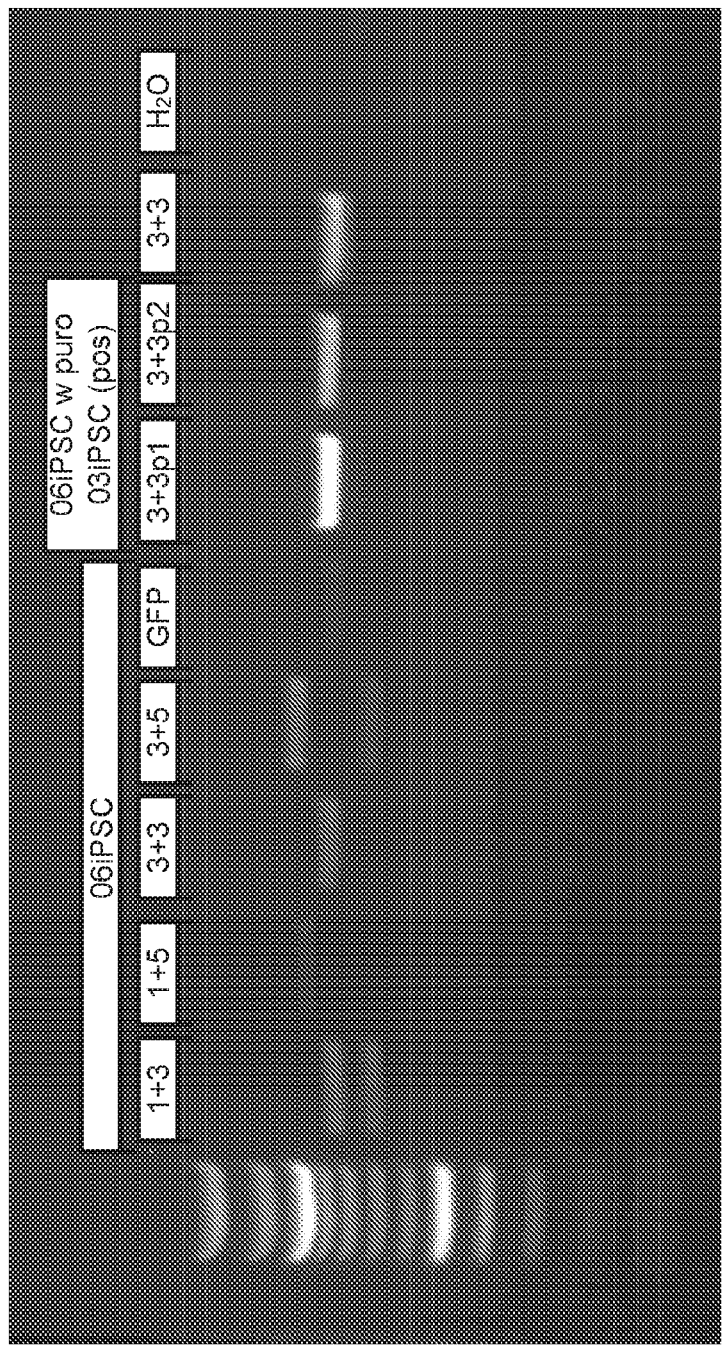
FIG. 14 depicts a gel showing successful genomic deletion with various pairs of guide RNAs in iPSC cells.
Figure 15:
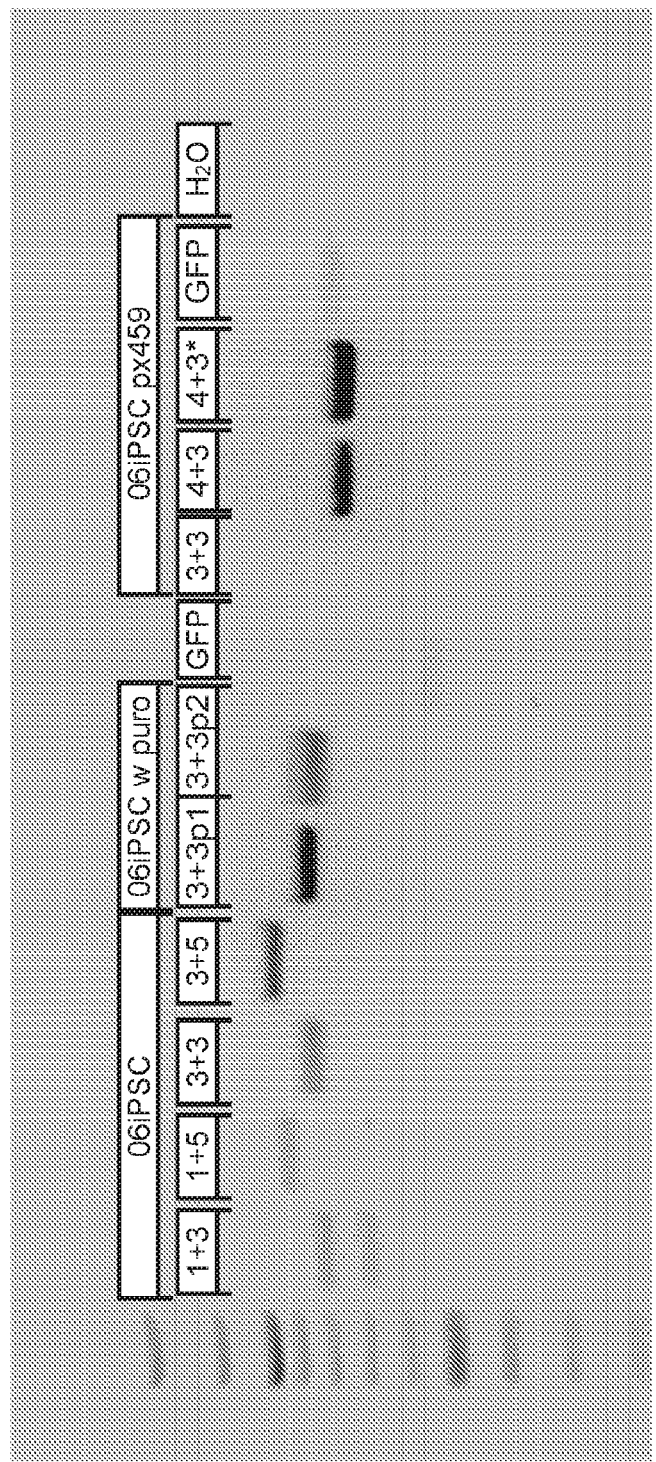
FIG. 15 depicts a gel showing successful genomic deletion with various pairs of guide RNAs in iPSC cells.
Figure 16:
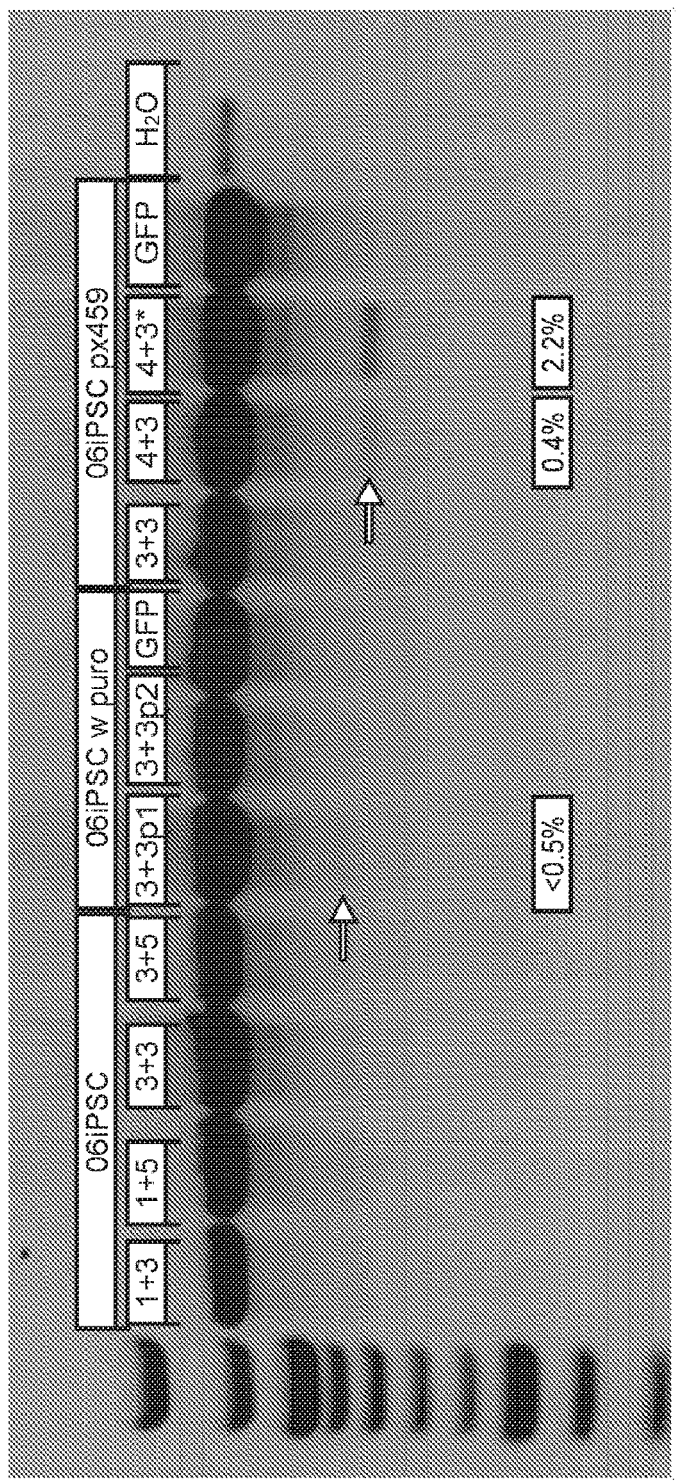
FIG. 16 depicts a gel showing successful genomic deletion with various pairs of guide RNAs in iPSC cells.
Figure 17:
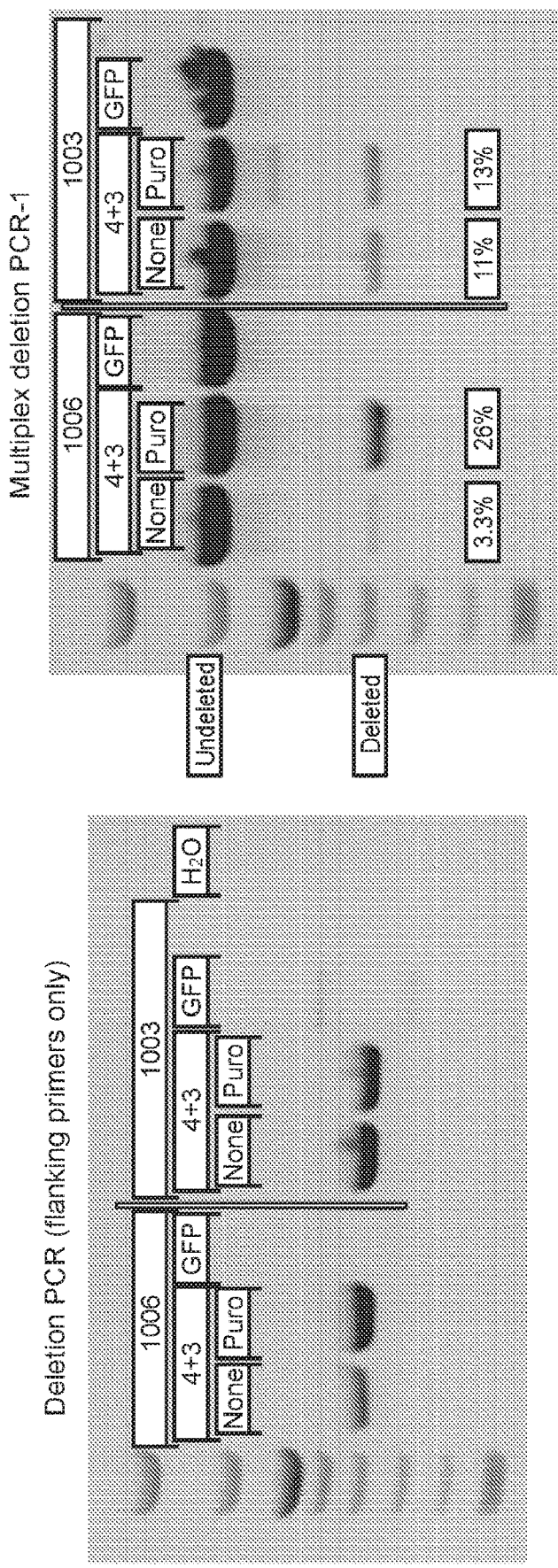
FIG. 17 depicts gels showing successful genomic deletion with a pair of guide RNAs.

Example 3: Various Pairs of Guide RNAs were Used for Successful Genomic Deletion FIG. 10 depicts a schematic depiction of guide RNAs that were tested (e.g., see Table 2; FIG. 23) and expected deletion size ('total deletion distance'). FIG. 11 depicts gels showing successful genomic deletion with various pairs of guide RNAs in 293T cells. FIG. 12 depicts gels showing successful genomic deletion with various pairs of guide RNAs in 293T cells. FIG. 13 depicts gels showing successful genomic deletion with various pairs of guide RNAs in iPSC cells. FIG. 14 depicts a gel showing successful genomic deletion with various pairs of guide RNAs in iPSC cells. FIG. 15 depicts a gel showing successful genomic deletion with various pairs of guide RNAs in iPSC cells. FIG. 16 depicts a gel showing successful genomic deletion with various pairs of guide RNAs in iPSC cells. FIG. 17 depicts gels showing successful genomic deletion with a pair of guide RNAs. FIG. 18 depicts a gel showing successful genomic deletion with a pair of guide RNAs.

Figure 20:
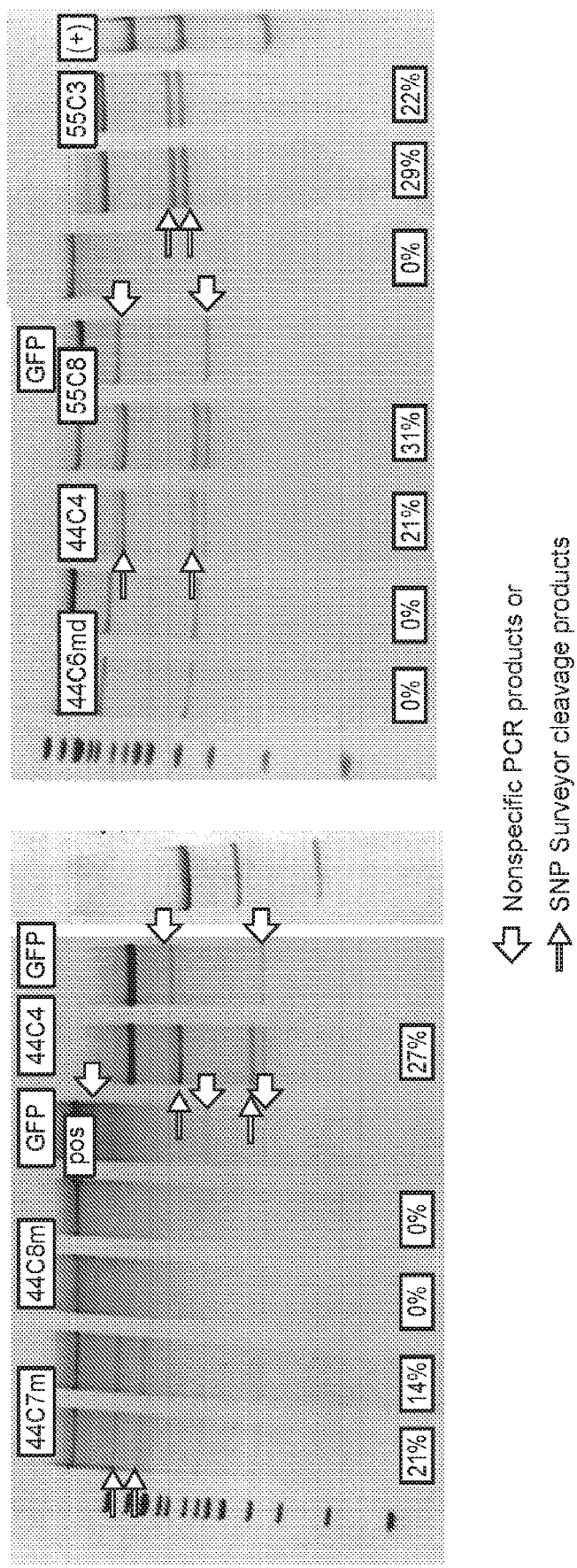
FIG. 20 depicts guide RNAs targeting intron 44 of the mutant dystrophin gene showing cutting by Surveyor assay.
Figure 21:
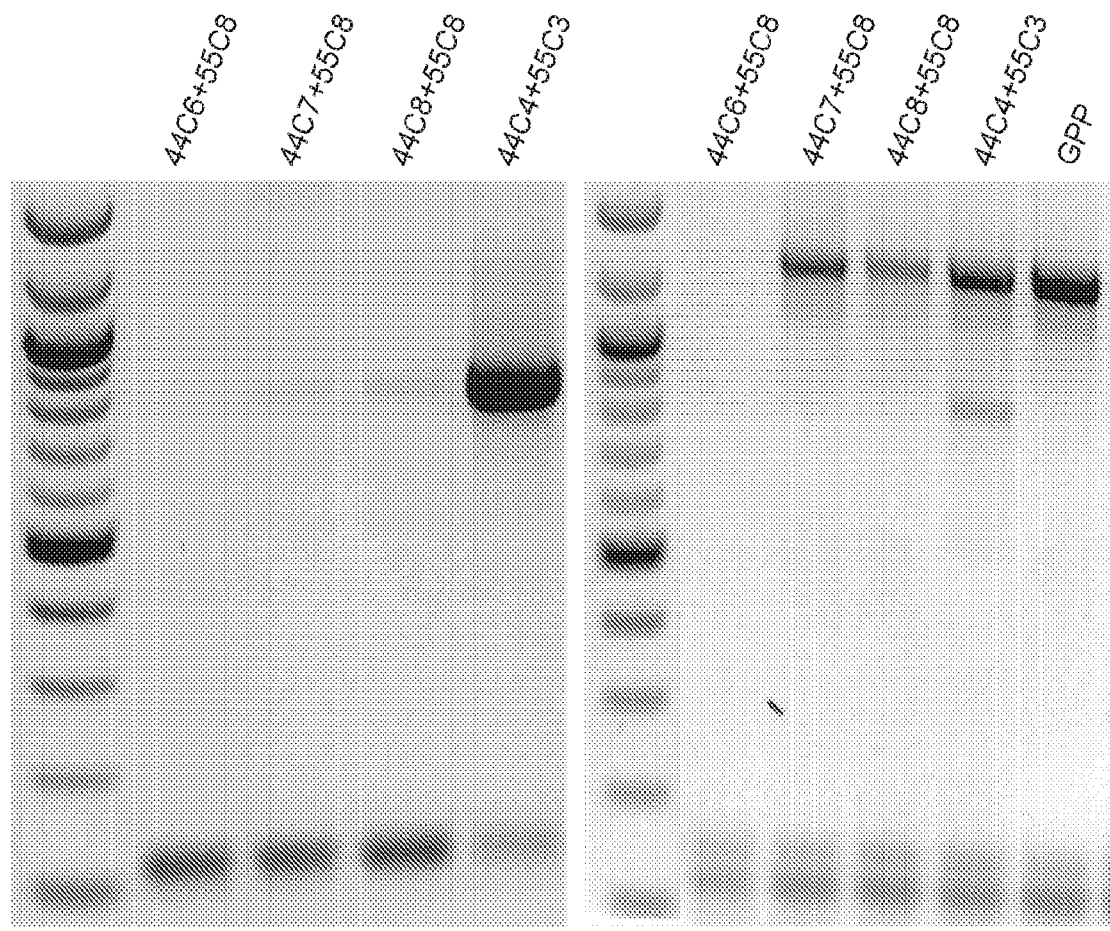
FIG. 21 depicts gels showing genomic deletion with various pairs of guide RNAs.
Figure 22:
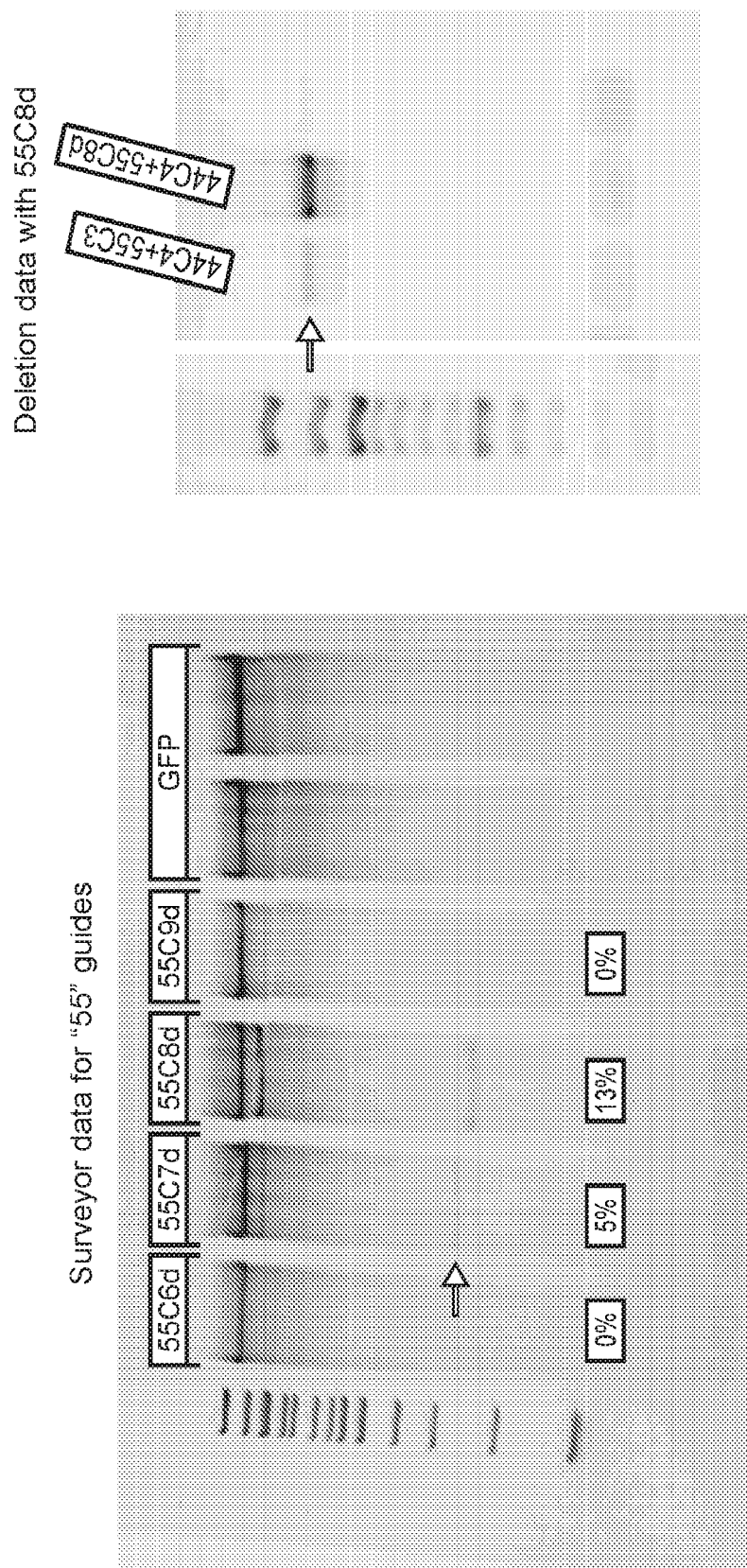
FIG. 22 depicts guide RNAs targeting intron 55 of the mutant dystrophin gene showing cutting by Surveyor assay.

Additional guide sequences of guide RNAs (and target sequences) are provided in FIG. 24 (Table 9). FIG. 19 provides activity of single-guide cutting activity in HEK293FT cells. FIG. 20 provides surveyor data for the "44" series of guide RNAs. FIG. 21 provides genomic deletion data for the "44" series of guide RNAs in combination with "55" series of guide RNAs. FIG. 22A provides surveyor data for the "55" series of guide RNAs. FIG. 22B provides genomic deletion data for combinations of "44" guide RNAs with "55" guide RNAs, specifically: 1) 44C4+55C3; and 2) 44C4+55C8d.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (1409 sequences)

SEQ ID NO: 1 - protein, 15 aa, artificial sequence
  synthetic sequence
IGLDIGTNSVGWAVI

SEQ ID NO: 2 - protein, 8 aa, artificial sequence
  synthetic sequence
IVIEMARE

SEQ ID NO: 3 - protein, 27 aa, artificial sequence
  synthetic sequence
DVDHIVPQSFLKDDSIDNKVLTRSDKN

SEQ ID NO: 4 - protein, 8 aa, artificial sequence
  synthetic sequence
HHAHDAYL

SEQ ID NO: 5 - protein, 1368 aa, Streptococcus pyogenes [sequence omitted]

SEQ ID NO: 6 - protein, 1367 aa, Streptococcus pyogenes
MDKKYSIGLDIGTNSVGWAVITDDYKVPSKKLKVLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNTSLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAKNIIHLFTLTNLGAPAAFKYFDTTIERNRYKSIKEVLDATLIHQSITGLYEIRIDLSQLGGD

SEQ ID NO: 7 - protein, 1056 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 8 - protein, 1368 aa, Streptococcus pyogenes
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 9 - protein, 1334 aa, Listeria innocua
MKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 10 - protein, 1368 aa, Streptococcus pyogenes; identical to SEQ ID NO: 8

SEQ ID NO: 11 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 12 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 13 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMRKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 14 - protein, 131 aa, Helicobacter hepaticus
MRILGFDIGITSIGWAYVESNELKDCGVRIFTKAENPKNGDSLAAPRREARGARRRLARRKARLNAIKRLLCKEFELNLNDYLANDGELPKAYQTSKDTKSPYELYTAFHWIIFAFCSIASSLSNRQMLPI

SEQ ID NO: 15 - protein, 1059 aa, Wolinella succinogenes
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 16 - protein, 1409 aa, Wolinella succinogenes
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 17 - protein, 1374 aa, Fusobacterium nucleatum
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 18 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDYAREIQEICRMQEIGQELYRKIIDVVFAAESPKGSASSRVGKDPLQPGKNRALKASDAFQRYRIAALIGNLRVRVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLSSQLSVSDIDKASSEALWCALTREPGFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 19 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 20 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHDNYRTIYHLREKLVNSSEKADLRLVYLALAHIIKYRGNFLIEGALDTKNTSVDEVYKQFIETYNQVFMSNIEEGALAKVEENIEVANILAGKFTRREKFERILQLYPGEKSTGMFAQFISLIVGSKGNFQKVFDLIEKTDIECAKDSYEEDLETLLAIIGDEYAELFVAAKNTYNAVVLSSIITVTDTETNAKLSASMIERFDAHEKDLVELKAFIKLNLPKQYEEIFSNAAIDGYAGYIDGKTKQVDFYKYLKTILENIEGSDYFIAKIEEENFLRKQRTFDNGAIPHQLHLEELEAIIHQQAKYYPFLKEDYDKIKSLVTFRIPYFVGPLANGQSEFAWLTRKADGEIRPWNIEEKVDFGKSAVDFIEKMTNKDTYLPKENVLPKHSLCYQKYMVYNELTKIRYIDDQGKTNYFSGREKQQVFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVAELAGSPAIKKGILQSLKIVDELVSIMGYPPQTIVVEMARENQTTGKGKNNSKPRYKSLEKAIKEFGSQILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILYQRFNKETDNHGNTMEQVRIVTLKSALVSQFRKQFQLYKVREVNGYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIKAIAQSFVDLMAFNAMGAPASFKFFEATIDRKRYTNLKELLSSTIIYQSITGLYESRKRLDD

SEQ ID NO: 21 - protein, 1236 aa, Mycoplasma mobile
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 22 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 23 - protein, 1122 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTNGETLDNIFGILIGKCTFYPDEFRAAKASYTAQEFNLLNDLNNLTVPTETKKLSKEQKNQIINYVKNEKVMGPAKLFKYIAKLLSCDVADIKGHRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRTDVYFNKNTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 24 - protein, 1128 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKRLRLQIKQNISNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEEQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLLGNPIDITPENSKNKVVLQSLKPWRTDVYFNKATGKYEILGLKYADLQFEKGTGTYKISQEKYNDIKKKEGVDSDSEFKFTLYKNDLLLVKDTETKEQQLFRFLSRTLPKQKHYVELKPYDKQKFEGGEALIKVLGNVANGGQCIKGLAKSNISIYKVRTDVLGNQHIIKNEGDKPKLDF

SEQ ID NO: 25 - protein, 1123 aa, Francisella tularensis
MNVKILPIAIDLDVKNTGVFSAFYQKGTSLEKLDNKNGKVYELSKDSYTLLMNNRTARRHKRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILGTLLTDDFDIWNFNFEKFDFDKNEEKLQNQEDKDHTQAHLHHFVFVVNKIKSEMASGGRHRSQYFQEITNVLDENNHQEGYLKNFCENLHNKKYSNLSVKNLVNLVGNLSNLELKPLRKYFNDKIHAKADHWDEQKFTETYCHWILGEWRVGVKDQDKKDGAKYSYKDLCNELKQKVTKAGLIDFLLELDPCRTIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDNNQLLTYCNHKPRQKRYQLLNDLAGVLQVSRNQLLSSVEEWFQQAQRVGEISKSQDEQIFEWLKSFKIASYCKAAVEMQKQYRGTLKNAIQTAIFRQSENINKNKNTGNQQQALSENSKDVKSLTADEKKLLKLIENIAKASQKIGESLGLNDKQIKKFNSIYSFAQIQQIAFAKRKGNANTCAVCSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNIFAIDTSKWFEIETPSDLRDIGVATIQYKIDNNSRPKVRVKLDYVIDDDSKINYFMNHSLLKSRYPDKVLEILKQSTIIEFESSGFNKTIKEMLGMTLAGIYNETSNN

SEQ ID NO: 26 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 27 - protein, 1314 aa, Mycoplasma synoviae
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 28 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSNNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIVKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATFIHQSITGLYETRIDLSQLGGD

SEQ ID NO: 29 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 30 - protein, 1370 aa, Streptococcus agalactiae; identical to SEQ ID NO: 11

SEQ ID NO: 31 - protein, 1173 aa, Rhodospirillum rubrum
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 32 - protein, 997 aa, Maritimibacter alkaliphilus
MKVLVDAGLMPSDPAAAKALETLDPYELRATGLDVMLPLTHLGRAVFHLNQRRGFKSNRKTDRGDNESGKIKDATKRLTWAMQEAGARTYGEFLHMRRARASDPRQVPSVRTRLSVASRGGPDSKEEAGYDFYPERAHLEDEFHALWSAQAAFHPDLTCELRDVVFEKIFYQRPLKEPKVGLCLFTAEERLPKAHPLTGRRVLYETVNQLRVTADGRTTRPLTLEERDMIVYALDNKKPVKSLSSMHLKLVALGKLVKLKDGERFTLESGVRDAIACDPIRATMGHPDGFGPAWSRLDWQAQWALIEKLRQVQSDDDFASLVAWLGATHNLSEDHAKRVANLHLPEGYGRLGLTATEAILCNLKAEVCTYSQAVERWGKHHSNQRTGECLEALPYYGEVLDRHVIPGTYNEDDDDVTRYGRITNPTVHIGLNQLRRLVNRIIATYGKPDQIVVELARELKQSEAQKSEALKKIRDTTADAIRRGRQLEEIGQKNTGANRLLLRLWEDLGPAVGPRCCPYTGKPISVTMLFDGACDVDHILPYSRTLDDSFANRTICLREANRQKGDRTPWEAWGGSDQWDAIEANLKDLPENKRKRFAPDAMERFEGERDFLDRALVDTQYLARISRAYLDTLFTEGGHVWVVPGRMTEMLRRHWGLNALLSDKDRGAGKVKNRTDHRHHAIDAAVIAATDHSLVNRISKAAGQGESAGQSAELIARDTPEPWEGFRNDISAQIARIVVSHRADHGRIDVEGRKHGKDSTAGRLHNDTAYGIVDDHTVVSRTPLLSLKPGDIEVTTKGKNIRDTQLQKALSVATTGKDGKGFEEALRNFAEKEGPYQGIRRVRLIETLQSSARVEVGSDEDGQPLKAYKGDSNHCYDLWKLPDGKVVPHVVSTYEAHAGTDKRPHPAAKRILRVFKKDMVAIEQDDQTAIFYVQKLDRANGLFLAPHLEANADARHRNPNDAFKFLQMGAGSVVRNKLRRVYVDEIGRIKDPGPPKH

SEQ ID NO: 33 - protein, 1027 aa, Blastopirellula marina
MFSESGDQPSLVDCGVRIFPEGVERDQQGGEKSKSQSRRVARGIRRQVRRRAQRLRHLKHALITTGLFPADVVDQQEVLASNPYELRSRALSEKLEPYEIGRILLHLAKRRGFLSNRTTDRSGGNELKGILAEMTQLQGEIAAHGCQTLGQYLHQLGDDGETFAQRLRGRHTLRAMYEDEFEKIWERQASYYPALLTEELRGGEEGKQSYPLVPTARRKSESLLKRFGLHGLLFFQRKMYWPKSVIGRCDLEPKEKRCPKADRLAQRFRILQEVNNLRLISPADRKEYTFAEFVGAGADKKLVDYLCEAKERTFPQIRKKFKLPETISFNYERGERSKLQGHETDAHFNGKKGLGKRRWSEIAEDVKDHIIQIVLEEDREDVALRKLTQDCSLTVEEAHKAMALHLPAGYSQYSRVAISRLLPHLELGKLLMGNDASDSAMHAAGYLRPDEREVRQYDLLPEPPDIPNPLVRQALYEVRKVINAIIREYGALGTIRVELAREAKKSAEQRTQIRIANAKRERENAAIAKTLQEMSPAIRPTRRNIQRYLLWKDQGGVCIYTGKVISQAQLFDSGEVDVDHILPRWRSLDDSMANKVIAHRSANNEKGDRTPWEWLGHDKPRFDELLLRAQRLPYGKRQRFIQKEVELTNFVERQLRDTTYVSRLVVQYLKGLGVPITTVKGPMTAELRHHWGLNALLNEDGSQKKNRSDHRHHAIDAIVIGLTDAKRLHALANARGKDLQPPWSEFRSDVATALGRMAVSHRVRRRIQGALHEETIYGPTQKAAQPTSTDQRPWAKDWIEDSQIVVRRKSVSDLTNTKHLAKIRDVTIRKILEDHLRRQKVDPTKPGVIPKDAFAGSNAPQMPSGVPIKKVRLVERGETWRKIGSGEASKFIKPGSNHHISYFAISRKGRESWKAHVTIMLDAACIAKESINNGKIVNRSIGDQGRFLMSLSIGEMFEITNNGGEILLCVVRKIDQSGRIYYKIHDDARESMDLKKDNLYMSPSKMQQFDARKVTVTPLGKIRNAND

SEQ ID NO: 34 - protein, 158 aa, Francisella tularensis
MIDFLLELDPCITIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLSEIYFQAKKLKQKASSELEKLESSKKLDEVIANSQLS

SEQ ID NO: 35 - protein, 393 aa, Francisella tularensis
MNVKILPIAIDLDVKNTGVFSAFYQKGTSLEKLDNKNGKVYELSKDSYTLLMNNRTAQRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQSQEDKDHTQAYFHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 36 - protein, 1066 aa, Rhodopseudomonas palustris
MSERVVRRILGIDLGIASCGWGVVDISGAGGGIIATGVRCFDAPLIDKTGEPKSATRRTARGQRRIVRRRRQRMNGVRRLLCEFGLLPDPRPDALNQAMRRISTASAAAQVTPWTLRAAAHQRLLSNEELAVVLGHIARHRGFRSNAKNEAGANAADETSKMKKAMEATREGLAKYHAFGDMIANDPKFANRKRNRDKDYSHTAKRSDLEDEVRAILRAQLRFGSAAATETLAQTFADVAFFQRPLQDSEDRVGDCPFEPGQKRAARRAPSFELFRFLSRLANLKLAVGRSPERRLTAEEIALAAKGFGETKKTITFKSLREALDLDPNARFSGIGKDKEASLDVVARTGGAAYGTKTLKDALGDAPWRSLSRTPETLDRIAEILSFREDITSIRNGLEDLGLDSLVVEALMQAAANGDFKEFTRAGHISARAARNIIPGLREGLVYSEACARVGYDHAARLSVPLDQVGSPVTRKALSEALKQVRAVAREYGPIDYFHIELARSVGKSAEERKQLTDGIEARNVEKAKRRKQAEEHLGRAPSDDELLRYELAKEQNFKCIYSGDAIDPAGVAANDTRYQVDHILPWSRFGDDSYLNKTLCTARSNQNKRGRTPFEWFEADKTDVEWMEYVARVENLQEVKGRKKRNYSIKDAAAIEDKFKARNLTDTQWATRLLADELSRMFPPRECERAICGRADGGNDGLTIVEERRVFTRPGAITSKLRRAWGLEGLKKQDGKRVEDDRHHAVDALVLAATTESLLQRLTVEVQRREREGRPDDIFHCAEPWRGFRADVRRTVYGSETMPGIFVSRAERRRARGKAHDATIKQIREIEGERLVFERKPVEKLTDKDLEKIPIPKPYGQVSDPKRLRDELVESLRAWIAAGKPKDRPPLSPKGDVIRKVRIQTNDKVSVEINGGTVDRGDMARVDVFRKKNKKAVWEYYVVPIYPHQIVALNDPPDRAVIAYAEDKDWKEIDSSYEFLWSLFGLSYVEISKANGECIDGYFRGLHRGTGAASVCKHISLGKDATVSGIGLKTLASFKKFTIDRLGRKFEIPREVRTWRGEACT

SEQ ID NO: 37 - protein, 1149 aa, Lactobacillus salivarius
MERYHIGLDIGTSSIGWAVIGDDFKIKRKKGKNLIGVRLFKEGDTAAERRGFRTQRRRLNRRKWRLKLLEEIFDPYMAEVDKYFFARLKESNLSPKDSNKKYLGSLLFPDISDSNFYDKYPTIYHLRRDLMEKDKKFDLREIYLAIHHIVKYRGNFLEKVPAKNYKNSGASIGFLLEEVNDLYGNIIGNEDVAILDNDKFEDVEKIILNDEIRNIDKQKNVGRLLVKDKKEKNIVTAFSKAIFGYKFNLEDLLLIESDEKNKLTFNDENIDDIFNELSHSLNDNQMDLLTKTREIYFKFKLNMIVPTGYTISESMIEKYEMHKAHLKMYKEFINTLNAKDRKILKNAYSDYINNEKAKAANAQENFYKTVKKTIKENDSDTAKKIIGLIDEGNFMPKQRTGENGVIPHQLHQIELDRIIENQAKYYPWLAEENPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKYKVLNELNNIKVNKKKLDVEQKQHVYLDLFTTRKNVTKDDLATSLNCDVESITGLTDNKKFNSSLSSYIDLKAILGNIVDDYSKNEDLEKIIEYSTIFEDGNIYKEKLSEISWLTDEQIEKLSNIHFKGWGRLSKKLLTQITNENGERIIDTLWNTSNNFIQVISDESIQAKLAEINGEYANKYNLEDILDEAYTSPQNKKAIRQVMKVVEDIEKAMKCEPTSIAIEFTREKRKSKLTNTRYKKISETYEKITDELISEYELGKLQSELDSKVNNMRDRYYLYFMQLGRDMYTGEKMNIDELHQKYDIDHILPQSFIKDDSLNNRVLTSKSVNIKEKSDKTAADLYAAKMGDFWRKLRKQGLMTEQKYKNLLTRTDSINKYTKQSFIKRQLVETSQVVKLAANILQDKYRNTKIIEIRARLNSDLRKKYELIKNREVNDYHHAIDGYLTTFVGQYLYKVYPKLRSYFVYDDFKKLDSNYLKHMDKFNFIWKLEDKKAEDVYDKVNDEFVLNVPEMKEYIRKIYNYKYMLVSKEVTTKNGAFYDQTKYNAKTINLIPIKKDKPTNIYGGYKGKVSSYMMLVKIQKKKEVIYKFVGVPRLWTDELDRLIDTDEKKALLKK

SEQ ID NO: 38 - protein, 1064 aa, Rhodopseudomonas palustris
MSECVTRRILGIDLGIASCGWGVIEVGEASGSIIASGVRCFDAPLIDKTGEPKSATRRTARGQRRIIRRRRQRMNAVRRLLAEFGVLTGRSPDALHQALLRLSQSVAGSQVTPWTLRAAAHERKLTNDELAVVLGHIARHRGFRSNSKNDGGANAADETSKMKKAMETTREGLARYHSFGAMIASDPKFADRKRNRDKDYSHTAKRSDLEDEVRTIFRSQTRFGSLVASEKLSQAFADAAFFQRPLQDSEDMVGSCPFEPGQKRTARRAPSFELFRFLSRLANLKLTVGRAPERRLTPDEIALAAKGFGETKKSITFKSLREALDLDPNARFSGVAKEKESTLDVAARTGGAAYGTKTLKDALGDAPWRSLSRMPEKLDRIAEILSFREDMKAIRNGLEEVGLDGLVVDALMQATANGDFKDFTRAAHISALAARNIIPGLREGLVYSDACTRVGYDHAARPAVPLSQIGSPVTRKALSEALKQVRAVAREYGPIDYFHIELARSIGKSAEERKKLTDGIEARNVEKEKRRKEAAEHLGRAPSDDELLRYELAKEQNFKCIYSGDPIDPAGISANDTRYQVDHILPWSRFGDDSYVNKTLCTARSNQNKRGRTPFEWFDADKTEAEWMEYSARVEDLKEVKGRKKRNYSIKDAASVEDKFKARNLTDTQWATRLLADELKRMFPPRECERVVTVRADGGNDGLSIVEERRVFTRPGAITSKLRRAWGLEGLKKQDGKRVEDDRHHAVDALVLAATTESLLNRLTVEVQQREREGRQDDIFHCSQPWPGFRVDVQRTVYGSETMPGIFVSRAERRRARGKAHDATVKQIRDIDGERIVFERKPIEKLTDKDLERIPVPEPYGKAADPKKLRDELVENLRAWIAAGKPKDKPPRSPKGDIIRKVRIETKDKVAVEINGGTVDRGDMARVDVFRKKNKKGVWEFYVIPIYPHQIVASALPPNRAVIAYKAESEWTAIDGCFEFAWSLNPMSYLELVKSNGELIEGYFRSMDRTTGAINLSPMSTNSETIRSIGVKTLSSFRKFTVDRLGRKFEIPREVRTWRGEACT

SEQ ID NO: 39 - protein, 1166 aa, Nitrobacter hamburgensis
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 40 - protein, 641 aa, Nitrobacter hamburgensis
MHKRNSRSYRLGLDLGSNSLGWFVTHLEKRGDRYEPVALDPGGVRIFPDGRDPQSGMSNAVDRRMARGARKRRDRFVDPYALRKAALTNALPAHRVGRAIFHLNQRRGFQSNRKTDRKQSEDGAIKQAASKLKARMHEEAAPTLGAFFADMHLRKSYDDQQTAIRAELVRLGKDHLTGNARKKVWAKVRKRLFGDEVLRPKDTSDGARARATTTGTKASYDFYPTRAMLLDEFNAIWAAQREHHLAMTDEAKAEIEHIIFYHRPLKPAIVGKCTLDPATRPFKEDPEGYRAPWSHPLAQRFRILSEARNLEIRETGKTSRRLTKDQSDLVVAALLANREVKFDKLRTLLKLPAEARFNLESDRRSTATRPPHGCRTRRASIRRGAGFLRNGRSRSSPDWKKPKTKTNCSHGSKWNAHLTAQRPRASPIRRCRTAIAGSACAQSKRSCRSCRTSSMRMALRAPAITSWPSVPATTIPVDTFQQGGNAFGRILSVVTIELFAITDRVDPVQEQDARCFALRIAECRSDGLQHFAEVSLGLPPRNAAQDQRHSAGLCQSSCVGRFVPGTPCRRTPRSTSLHGKEPSAHAFGSTARSRPQLPASPRPCMSFRDGTSSSPARMPETLDRCAISRSNRSSVCRAERL

SEQ ID NO: 41 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTVWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 42 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGLTIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 43 - protein, 1368 aa, Streptococcus pyogenes
MDKKYSIGLDIGTNSVGWAVITDDYKVPSKKFKVLGNTDRHSIKKNLIGALLFDSGEIAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRLNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMLAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPTAFKYFDTTIDRKRYTSTKEVLDATFIHQSITGLYETRIDLSQLGGD

SEQ ID NO: 44 - protein, 1371 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGSD

SEQ ID NO: 45 - protein, 1121 aa, Streptococcus thermophilus
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 46 - protein, 1388 aa, Streptococcus thermophilus
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 47 - protein, 1138 aa, Acidothermus cellulolyticus
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 48 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRADGTKPFIPAFDISKNEIVEAIIDSFTSKNIFWLPKNIELQKVDNKNIFAIDTSKWFEVETPSDLRDIGIATIQYKIDNNSRPKVRVKLDYVIDDDSKINYFMNHSLLKSRYPDKVLEILKQSTIIEFESSGFNKTIKEMLGMKLAGIYNETSNN

SEQ ID NO: 49 - protein, 1068 aa, Verminephrobacter eiseniae
MNKAVAYRLALDLGSTSLGWAIFRLNEAREPTAIIRAGVRIFSDGRNANSEPLAVHRRVARAMRRRRDRLLKRKKRMHDQLVQHGFFPAEVAERKELERLNPYQLRAKGLHEALTPGEFARALFHINQRRGFKSNRKTDRKDNDSGALKQAISELRKRIQDSDCATAGEWFWKERMQQKPEGVRGQWVRARYRKTPSTTDEGKKRIGYDLYVDRAMVEQEFDALWAAQAALQPGLFTEAARAELKDTLLYQRDLRPVKPGRCTLLPAEERAPLALPSTQRFRILQEVNNLRLLDEALREVPLNLAQRDAVVSALEGKKELSFAAIRKLLTLSGKFNLEDEKRAELKGNATSVILARKDLFGDAWAGFDAAVQDEIVWRLVSQESEGALIAWLQQHTGVDGVCAEAIVNTRLPDGYGRLSRKALERIVPALQREVCTYDKAVQAAGFAHHSDLGFDFDYAEDEVQQVGEHTIASTGEVQAQYAFKQLPYYGKALQRHVAFGSGDAKDHEEKCYGKIANPTVHIGLNQVRTVVNALIRRYGHPTEVVVELARDLKQSREQKQQTQREQADNQKRNEDIRKRIAPILETSPERVRDRDIKKWILWEELNKKDIADRHCPYSGERISATMLLSEAVEIEHILPFSRTLDDSLNNRTVAMRRANRIKGDRTPWEARADFEAQGWRYEAILQRAEGMPPRKRYRFAEDGYQRWLGKDRNFLARALNDTSYLSRLAANYLRLVCPQGVRVIPGQMTDKLRGKFGLNSVLGLDGKKNRNDHRHHAVDACVIGVTDQGLMQRFANASKQARENGLTRLVQDMLLPWWPSYYDHVERAVRHIRVSHRPDHGFEGAMMKGTAHGIREDGIREDGRIKQRPKAKGSADHKTITLIPIDEPRQLARHGVDAEGKPLPYKGYASGSNYCIEITKNGKGKWEGQVISTFDAYRIKAAADAAARAGQVISTVEADSIVRKSGWERLRGAQSQNGQPLVMRLVIGDSVRMEVDGRDEVMRVVKMSGKEMVFAPVREANVDKRNNMPDEQDPFTYTYKRADQLRKAKARQVTISPIGELRDPGFKG

SEQ ID NO: 50 - protein, 1125 aa, Francisella tularensis
MNVKILPIAIDLDVKNTGVFSAFYQKGTSLEKLDNKNGKVYELSKDSYTLLMNNRTARRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKIQKFSYTDKQGNLKELSYYHHDKYNIQEFLKRHATINDEILDTLLTDDFDIWNFNFEKFDFDKNEEKLQNQEDKDHTQAHLHHFVFAVNKIKSEMASGGRHRSQYFQEITNVLDENNHQEGYLKNFCENLHNKKYSNLSVKNLVNLVGNLSNLELKPLRKYFNDKIHAKADHWDEQKFTETYCHWILGEWRVGVKDQDKKDGAKYSYKDLCNELKQKVTKAGLIDFLLELDPCRTIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDNNQLLTYCNHKPRQKRYQLLNDLAGVLQVSRNQLLSSVEEWFQQAQRVGEISKSQDEQIFEWLKSFKIASYCKAAVEMQKQYRGTLKNAIQTAIFRQSENINKNKNKNTGNQQQALSENSKDVKSLTADEKKLLKLIENIAKASQKIGESLGLNDKQIKKFNSIYSFAQIQQIAFAERKGNANTCAVCSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNIFAIDTSKWFEIETPSDLRDIGVATIQYKIDNNSRPKVRVKLDYVIDDDSKINYFMNHSLLKSRYPDKVLEILKQSTIIEFESSGFNKTIKEMLGMTLAGIYNETSNN

SEQ ID NO: 51 - protein, 1064 aa, Bradyrhizobium sp.
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 52 - protein, 1354 aa, Flavobacterium psychrophilum
MKKILGLDLGTNSIGWAFINEAENEIEVSSIVNTGVRIVPLTTDEESDFKKGNTISINADRTLKRGARRGLQRFKQRREALLETFNRIKFIATDFVYAETGAATTFSSYQLRAKSAVEAVTKEELVKVLLMLNKKRGYKSSRKAKTAEEGDAIDGMKIAKEIFENNLTPGQWVYNSLSKGGKFIPDFYHSDLQKELEKIVRFQNQFHSEQINDKLLADIQGKSRTQTSQHFSKTLNIPLAENKGTREETKLQHYQWRNEALANELDMKILAFIITEINNQINQSSGYLGAISDRSKELYFNQETVGQYQYKQLQENVHAKLKNQVFYRQDYLDEFEKIWETQAKFHSELNEKLKAEIRDITIFYQRKLKSQKHLVSFCEFEKGHKAIPKSSPLFQEFRIWQNLNNVVVKNETTKEVFELSEELKQLIAEELQFKESMTDVQMLTFCELKKGTHTVNFKKIEGNRTNTSIYKAFEKILEVEGYEIDFSKMKPLEIKETVAPIFETLNINTVILDFDPTIQGNDFDKQPYYQLWHLLYSAEDDDKLKETLKTKFGFKENHLPFILNINLQADYGSLSAKAIKKILPHLMDGHIYDKACLMVGYNHSSSLTTAQNNDRVLKDTLELLKKNSLRNPVVEKILNQMINVINAIMKDPAMGKPDEIRVELARELKANNEQRKKATSDINTATTEHERIRKLLHSEFNIPRVTRNDIIRYKLWLETGGISLYTGNPIKASDLFSKNYDIEHIIPKSRLFDDSFSNKTLCERQLNIDKSNKTAYSFLQEKLSENDFAAYENRVKDLFKTGKIKSYTKYKKLLMADNEIPEGFIDRQLRETQYIAKKAKEILLEVSRNVTATIGSVTDKLRQDWELVDVMKELNWEKYDKLGLTHIEEGKNGERLSKIKDWTKRNDHRHHAMDAITVAFTKPAYIQYLNNLNAKTQGENKANSIIGIENKHLYRDKNNKLRFISPMKNFREEAKKQLESILISYKAKNKVVTKNKNTTKKSGGTNQKIQLTPRGRLHKETVYGKLQQYATKEEKVNASFTEDYIQKVAKKEYREALLKRLEENDNDPKKAFTGKNALNKTPIYISLKDNIIVPEKVKTVWLETDYTIRKDITPDLKIDKVIDVGIKRILQNRLNEFNGDPKKAFVNLGESPIWLNKEKGIAIKRVTISGVSNAQALHTKKDHLGNEILDKNGNPIPVDFISTGNNHHVAIYRDEKGNLQEEVVSFYDAVIRRNLGLSVINKNHEKGWEFLFSMKQNEFFIFPSDGFNPHEIDLLNPNNYHLISPNIFRVQKISTKNYMFNHHLETKAVDGEMLKSKKELSKTSYHFIQTPTNLNGIIKVRINHLGKIVHLGEY

SEQ ID NO: 53 - protein, 1062 aa, Actinobacillus succinogenes
MNLNYILGLDLGIASVGWAVVEIDEQENPQRLIDVGVRTFDRAEVLKTGESLALARRLARSSRRLVKRRAERIKKAKRLLKAENLLLSADEILPNEAWQLRVKGLDQKLERQEWAAVLLHLLKHRGYLSQRKNESKSENKELGALLSGVAINHQILQSAEYRTPAEIAVNKFQAEEGHIRNQRGAYTHTFSRLDLLAEMELLFQRQATLGNPHTSTKLLENLTALLMWQKPALAGEAILKMLGKCTFEPTEYKAAKNSYSAERFVWLTKLNNLRILEQGAERALTDNERFALLDQPYEKAKLTYAQVRTLLGLSDEAIFKGLRYQGEDKKAVETKTTLMEVKAYHQIRKALEGLDLKAEWNELKNNPALLDEIGTAFSLYKTDDDIHRYLDGKLSESVLNALLENLNFDKFIQLSLKALQQILPLMLQGQRYDEAVSAIYGDHYGKKSDEIDRLLPNIPTDEIRNPVVLRTLTQARKVINAVVRLYGSPARIHIETGREVGKSYQDRKKLEKQQEENRKQRENAVKKFKEYFPNFVGEPKGKDILKMRLYELQQAKCLYSGKSLELYRLLEKGYVEVDHALPFSRTWDDSFNNKVLVLANENQNKGNATPYEWLDGKNNSEGWQHFVARVQTSGFSYAKKQRVLIQELDEKSFIERNLNDTRYVARFLCNHIADNMLLTGKGKRKVFASNGQITALLRGCWGLQKVRENNDRHHALDAVVVACSTKSMQDKITKFVKYKEGRLFKDKKDGVYKGERINRETGEIISLHFPTPWKFFKENVEIRIFSENPKLELENRLPDYPQYNHEFVQPLFVSRMPTRKMTGQGHMETVKSAKRLDKGLSVLKVPLTQLKLSDLERMVNREREMALYEALKECLEQFGNDPAKAFAEPFYKKGGALVKAVRVEQTQKSGVLVRNGNGVADNATGSIVRVDVFTKGGKYFLVPIYTWQVAKGILPNKAVIQGKDESEWEEMDENAVFQFSMHKNDLIKVKTKKGEIFGYFNGLDRATGSIEIEEHDLEKSKGKNGSHRGLGVKTAFFLEKYQVDELGKNIRPCRPTKRQHVR

SEQ ID NO: 54 - protein, 1340 aa, Dorea longicatena
MEQEYYLGLDMGTGSVGWAVTDSEYHVLRKHGKALWGVRLFESASTAEERRMFRTSRRRLDRRNWRIEILQEIFAEEISKKDPGFFLRMKESKYYPEDKRDINGNCPELPYALFVDDDFTDKDYHKKFPTIYHLRKMLMNTEETPDIRLVYLAIHHMMKHRGHFLLSGDINEIKEFGTTFSKLLENIKNEELDWNLELGKEEYAVVESILKDNMLNRSTKKTRLIKALKAKSICEKAVLNLLAGGTVKLSDIFGLEELNETERPKISFADNGYDDYIGEVENELGEQFYIIETAKAVYDWAVLVEILGKYTSISEAKVATYEKHKSDLQFLKKIVRKYLTKEEYKDIFVSTSDKLKNYSAYIGMTKINGKKVDLQSKRCSKEEFYDFIKKNVLKKLEGQPEYEYLKEELERETFLPKQVNRDNGVIPYQIHLYELKKILGNLRDKIDLIKENEDKLVQLFEFRIPYYVGPLNKIDDGKEGKFTWAVRKSNEKIYPWNFENVVDIEASAEKFIRRMTNKCTYLMGEDVLPKDSLLYSKYMVLNELNNVKLDGEKLSVELKQRLYTDVFCKYRKVTVKKIKNYLKCEGIISGNVEITGIDGDFKASLTAYHDFKEILTGTELAKKDKENIITNIVLFGDDKKLLKKRLNRLYPQITPNQLKKICALSYTGWGRFSKKFLEEITAPDPETGEVWNIITALWESNNNLMQLLSNEYRFMEEVETYNMGKQTKTLSYETVENMYVSPSVKRQIWQTLKIVKELEKVMKESPKRVFIEMAREKQESKRTESRKKQLIDLYKACKNEEKDWVKELGDQEEQKLRSDKLYLYYTQKGRCMYSGEVIELKDLWDNTKYDIDHIYPQSKTMDDSLNNRVLVKKKYNATKSDKYPLNENIRHERKGFWKSLLDGGFISKEKYERLIRNTELSPEELAGFIERQIVETRQSTKAVAEILKQVFPESEIVYVKAGTVSRFRKDFELLKVREVNDLHHAKDAYLNIVVGNSYYVKFTKNASWFIKENPGRTYNLKKMFTSGWNIERNGEVAWEVGKKGTIVTVKQIMNKNNILVTRQVHEAKGGLFDQQIMKKGKGQIAIKETDERLASIEKYGGYNKAAGAYFMLVESKDKKGKTIRTIEFIPLYLKNKIESDESIALNFLEKGRGLKEPKILLKKIKIDTLFDVDGFKMWLSGRTGDRLLFKCANQLILDEKIIVTMKKIVKFIQRRQENRELKLSDKDGIDNEVLMEIYNTFVDKLENTVYRIRLSEQAKTLIDKQKEFERLSLEDKSSTLFEILHIFQCQSSAANLKMIGGPGKAGILVMNNNISKCNKISIINQSPTGIFENEIDLLKI

SEQ ID NO: 55 - protein, 984 aa, Campylobacter jejuni
MAKILAFDIGISSIGWAFSENDELKDCGVRIFTKAENPKTGESLALPRRIARSARKRLARRKARLNHLKHLIANEFKLNYEDYQSFDEILAKAYKGSLISPYELRFRALNELLSKQDFARVILHIAKRRGYDDIKNNGDEEKGKILKAIKQNEEKLANYQSVGEYLYKEYFQKFKENSKEFINVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTLYTKDDLNALLNEVLKNGTLTYKQTKKLLGLSDDYEFKGEKGNYFIEFKKYKEFIKALGEHSLSQDDLNEIAKDITLIKDEIKLKKALAKYDLNENQIDNLSKLEFKDHLNISFKALKLITPLMLEGKKYDEACNELTLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNTAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREEFKNELR

SEQ ID NO: 56 - protein, 1037 aa, Parvibaculum lavamentivorans
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 57 - protein, 1107 aa, Eubacterium ventriosum
MGYTVGLDIGVASVGVAVLDENDNIVEAVSNIFDEADTSNNKVRRTLREGRRTKRRQKTRIEDFKQLWETSGYIIPHKLHLNIIELRNKGLTELLSLDELYCVLLSMLKHRGISYLEDADDGEKGNAYKKGLAFNEKQLKEKMPCEIQLERMKKYGKYHGEFIIEINDEKEYQSNVFTTKAYKKELEKIFETQRCNGNKINTKFIKKYMEIYERKREYYIGPGNEKSRTDYGIYTTRTDEEGNFIDEKNIFGKLIGKCSVYPEEYRASSASYTAQEFNLLNDLNNLKINNEKLTEFQKKEIVEIIKDASSVNMRKIIKKVIDEDIEQYSGARIDKKGKEIYHTFEIYRKLKKELKTINVDIDSFTREELDKTMDILTLNTERESIVKAFDEQKFVYEENLIKKLIEFRKNNQRLFSGWHSFSYKAMLQLIPVMYKEPKEQMQLLTEMNVFKSKKEKYVNYKYIPENEVVKEIYNPVVVKSIRTTVKILNALIKKYGYPESVVIEMPRDKNSDDEKEKIDMNQKKNQEEYEKILNKIYDEKGIEITNKDYKKQKKLVLKLKLWNEQEGLCLYSGKKIAIEDLLNHPEFFEIDHIIPKSISLDDSRSNKVLVYKTENSIKENDTPYHYLTRINGKWGFDEYKANVLELRRRGKIDDKKVNNLLCMEDITKIDVVKGFINRNLNDTRYASRVVLNEMQSFFESRKYCNTKVKVIRGSLTYQMRQDLHLKKNREESYSHHAVDAMLIAFSQKGYEAYRKIQKDCYDFETGEILDKEKWNKYIDDDEFDDILYKERMNEIRKKIIEAEEKVKYNYKIDKKCNRGLCNQTIYGTREKDGKIHKISSYNIYDDKECNSLKKMINSGKGSDLLMYNNDPKTYRDMLKILETYSSEKNPFVAYNKETGDYFRKYSKNHNGPKVEKVKYYSGQINSCIDISHKYGHAKNSKKVVLVSLNPYRTDVYYDNDTGKYYLVGVKYNHIKCVGNKYVIDSETYNELLRKEGVLNSDENLEDLNSKNITYKFSLYKNDIIQYEKGGEYYTERFLSRIKEQKNLIETKPINKPNFQRKNKKGEWENTRNQIALAKTKYVGKLVTDVLGNCYIVNMEKFSLVVDK

SEQ ID NO: 58 - protein, 1136 aa, Streptococcus gordonii
MNGLVLGLDIGIASVGVGILEKDTGKIIHASSRLFPAATADNNVERRSNRQGRRLNRRKKHRSVRLQDLFEGYGLLTDFSKVSMNLNPYQLRVQGMENQLTNEELFVALKNIVKRRGISYLDDASEDGGTVSSDYGKAVEENRKLLAEKTPGQIQLERFEKYGQLRGDFTVEENGEKHRLINVFSTSAYRKEAERILRKQQEFNSKITDEFIEDYLIILTGKRKYYHGPGNEKSRTDYGRFRTDGTTLDNIFGILIGKCTFYTEEYRASKASYTAQEFNLLNDLNNLTVPTETKKLSEEQKKLIIEYAKSAKTLGASTLLKYIAKMIDASVDQIRGYRVDVNNKPEMHTFEVYRKMQSLETIKVEELPRKVLDELAHILTLNTEREGIEEAINSKLKDIFNRDQVLELVQFRKNNSSLFSKGWHNFSIKLMMELIPELYETSEEQMTILTRLGKQRSKETSKRTKYIDEKELTEEIYNPVVAKSVRQAIKIINEATKKYGIFDNIVIEMARENNEEDAKKDYIKRQKANQDEKNAAMEKAAFQYNGKKELPDNIFHGHKELTTKIRLWHQQGEKCLYTGKNIPISDLIHNQYKYEIDHILPLSLSFDDSLSNKVLVLATANQEKGQRTPFQALDSMDDAWSYREFKSYVKDSKLLSNKKKDYLLTEEDISKIEVKQKFIERNLVDTRYSSRVVLNALQDFYKSHQLDTTISVVRGQFTSQLRRKWGIEKSRETYHHHAVDALIIAASSQLRLWKKHSNPLIAYKEGQFVDSETGEIVSLSDEEYKELVFKAPYDHFVDTLRSKKFEDSILFSYQVDSKYNRKISDATIYATRKAKLDKEKKEYTYTLGKIKDIYALGTKTPSKTGFYKFLDLYKTDKSQFLMYQKDRKTWDEVIEKIIEQYRPFKEYDKNGKEVDFNPFEKYRIGNGPIRKYSKKGNGPEIKSLKYYDILLGKHKNITPDGSRNTVALLSLNPWRTDVYYNSETKKYEFLGLKYADLCFEEGGAYGISEVKYKKIREKEGIGKNSEFKFTLYKNDLILIKDTETNCQQFFRFWSRTGKDNPKSFEKHKIELKPYEKAKFEKGEELKVLGKVPPSSNQFQKNMQIENLSIYKVKTDILGNKHFIKKEGDEPKLKFKK

SEQ ID NO: 59 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 60 - protein, 1079 aa, Dinoroseobacter shibae
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 61 - protein, 1096 aa, Eubacterium dolichum
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 62 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPAEPKAAKNTYTAERFIWLTKLNNLRILEQGSERPLTDTERTTLIDEPYRKSKLTYAQARKLLELDNTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIDLPPIPADEIRNPVVLRALSQARKVINGVVRRYGSPARIHIETAREVGKSFKDRKEIEKRQEENRKDREKAATKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 63 - protein, 1050 aa, Gluconacetobacter diazotrophicus
MGENMIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALTISAHNDPKSIHSGIGTKTLLAISKYQVDRFGRKSPVRKEVRTWHGEACISPTPPG

SEQ ID NO: 64 - protein, 1391 aa, Kordia algicida
MKKILGLDLGTNSIGWALVNEAEHEHEQSSIVKLGVRVNPLSVDEKTNFEKGRPLSINADRTSKRSARRNLQRFKLRRKNLINLLLKHHIISNETILTEVGKNTTHQTLKLRSKATQEKISLEEFARILLSINKKRGYKSSRKEKNEDEGFTIDGMAIAKELYDNQLTPGQYVYNILQDGKNYIPDFYRSDLQAEFDDVWQFQKKFYSSILTDEFYLKLKGQGKENTRKLFLAIHQVYTAENKGKRDAVKLQYYKWRSEAVKKQLSIEEVAYVLVEINNNINKSSGYLGAISDRSKALYFNNETVGEYLYGQLVKNRHNSLRNQVFYRQDYLDEFEKIWETQAKFYDELTNELKQEIRDVVIFYQRKLKSQKHLISDCLFEKHHKAIPKSSPLFQEFKIWQNLNYLEFVHTQSKEKIFFSELDDETRQFVFAELNIRGTLKIKEIKKLIGLETPVYWKSNFDEIEGNRTNQVLYNVYQNIADDLGYGFDWSKKHAFEINAELQAIFKDVGIDTAILNFDASIEENDFDKQKSYQLWHLLYSAEDTDKATEEDKLIYGNINTKLKKQLHQKYGFEAKYGNLLANISLQQDYGNLSAKAIKKILPYLESGNSFYEACTIVGYNPSNSLTKEQQQNRKLKDKLELLPKNSLRNPVVEKILNQKVNLINQLIDEYGKPDEVRIELARELKKSAKQRADLSKHINDATLKNQNIRKTLQKDFGIQNPSKNDVIRYKLYDELKDNGYKTLFTNKYIPKEQLFSKDVDIEHIIPKAILFDDSFSNKTLAYRNVNLAKADATAFDFISSKHLDDLDNYKARVETLFQSKRISKGKYKKLLMTRQNLPEDFIERDLRNSQYIAKKATAMLKEVFRSVVPTSGRITDKLREDWDLVNVMKELNLPKYRTLGLTEFIERKNGNKIEQIIDWTKRNDHRHHAMDALTVAFTTHNHIQYLNNLNVTHGLNGVDTDHEKSRLYAIKQAITKVYIVGKTKKRKFIPPMENFRSHAKNHLEGILISFKNKNKVVTKNKNRTKTKTKGVFNEKIQLTPRGQLHKETIYGHAKKVIVTKEKVSSKFTHEKILQVTKPAYREALLKRLASFKNDPKKAFSGKNALSKNPLYFDITSGKKVPDTVKLSYFENSYVIRKEVNSDNFKNEKSLQKVLDVGIRRILEKRLADYNGNAKEAFSNLEKNPIWKDKEKGVCIKKVRIEALKNAEPLHVKKDHLGKIILDDENKSTPVDFISTGNNHHVAIYEDKDGKLHDKVVSFYEVVSRVNLGLPIIDKSFNSHLDWKFLFSMKQNEMFVFPSEDFNPKEIDIGNPKNNELISKYLFRVQKFSKVTYGNSAVRDYVFRHHLETELIDKKELKGITYYQLKSIGMLEKLVKVRINHIGKIVHIGEY

SEQ ID NO: 65 - protein, 1116 aa, Clostridium spiroforme
MVEFLLKEMKIMGRLVLGLDIGITSVGYGVIDIDKNEFVDYGVRLFKEGTAINNEERRSKRGARRLKRRKTNRIADMKKLLERNGLIDEQYTALNNPYEIRKKGLKNKLSNYELATAILHITKNRGTCLESNADETQDEESTKNILSKNALELKDKYICEIQLARLEESGKIRGINNNFKTEDYLKELSKILENQDLEKETIDKIKEIVARRRRYDQGPGSEKSPTPYGSYRMENGELVHVNLIDMMRGKCSVFPDQLRAPQQSYSAELFNLLNDLNNLKINGEKLSSTEKQKIIDFVNEKGGITVKQLLKLIDVGITEISGFRIDKNEKPLITEFKGYKKVLKVFKNYNQESLLNDKSIVDTIMDINTKIKSIDERSDQLKQVLPSLDTSIINDLASIKGVSGYHSLSLKALNLINNEMLKTEMNQMQVLHQLDIFDKNRVSLKGQRQIYADDNAILSPVAKRAHRETFKVINKLRSIYGEFDSIVIETTRDKNTQDQKKRIKNNQKNYEERNTEVNNFLKEAGYNPENINAKTKMKIRLYIEQDAKSAYTLQDINLKELIEDEKAYEIDHIIPISISLDDSFNNKVLTTHDENQEKGNLTPISAFLKGKFHNGNLNTYKVFIQNNKNLNRKKKEYLLCEDDITRYEVVQNFINRNLVDTSYACRTVMNTLVHYFKDNEINTKVHTIKGQATSTFRKRIGLIKDREEDYFHHAIDALIVASLKKMNLINSYLMKVDFNEMYDEETGEIFNVLPDNSYLDEKYISFVSNLKNIYEESNKYIRGVMIKEKMTYPLIKVSHKIDTKPNRKISDDTIYSTRNVDNQDMLVERIKNIYDPKENAANTLINDIINDNTDKYIMYHKDPQTFDKIKAIVLNHFNEFKTDKNCYIVTKEGLYKLKGTSPLALYYEEFGPITKYAKKNNGPTIHSMKFYSEKLGNHLSITHKYSTVNKKVITKQISPYRTDFYQSPEGKYKFVTVRYKDVAYNAKKDKYIIDHSWYREQKKLKKIADEWIFVCSVHRDELIGIMKADGQKRIFDSSTESDGETLYHDAKTYEILKFTATNNDITGRFEVKPIYCYCKKQLMVSIGTCRKIQKFATDVLGNLYIVKDNVLKLEFK

SEQ ID NO: 66 - protein, 1348 aa, Finegoldia magna
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 67 - protein, 1129 aa, Streptococcus infantarius
MSNGKILGLDIGVASVGVGIIDSKTGNVIHANSRLFSAANAENNAERRGFRGARRLTRRKKHRVKRVRDLFEKYDISTDFRNLNLNPYELRVKGLTEQLTNEELFAALRTIAKRRGISYLDDAEDDSTGSSDYAKSIDENRRLLKTKTPGQIQLERLEKYGQLRGNFTVYDENGEAHRLINVFSTSDYKNEARKILETQSNYNKQITDEFIEDYIEILTQKRKYYHGPGNEKSRTDYGRFRTDGTTLENIFGILIGKCSFYPEEYRASKASYTAQEFNFLNDLNNLKVPTETGKLSTEQKEYLVDFAKKSKALGASKLLKEIAKIVDCSVDDIKGYRVDNKDKPDLHTFEPYRKLKFNLSSIDIDELSRETLDKLADILTLNTEREGIEDAIKRNLPSQFTEEQISEIVQIRKNQSSAFNKGWHSFSAKLMNELIPELYVTSEEQMTILTRLEKFKVNKKSSKNTKTIDEKEITDEIYNPVVAKSVRQTIKIINAAVKKYGDFDKIVIEMPRDKNAEDEKKFIDKKQKENKKEKDDSLKRAAFLYNGTDNLPDGVFHGNKELKTKIRLWYQQGERCLYSGKLISIHDLVHNSNKFEIDHILPLSLSFDDSLANKVLVYAWTNQEKGQKTPYQVIDSMDTAWSFREMKDYVLKQKGLGKKKCEYLLTTENIDKIEVKKKFIERNLVDTRYASRVVLNSLQTALKELGKDTKVSVVRGQFTSQLRRKWNIDKSRETYHHHAVDALIIAASSQLKLWQKQENPMFESYGENQVVNKETGEILSISDDKYKELVFQPPYQGFVNTISSKGFEDEILFSYQVDSKFNRKVSDATIYSTRKAKLGKDKKDETYVLGKIKDIYSQDGFDTFIKRYKKDKTQFLMYQKDPLTWENVIEVILRDYPSEKLSEDGKKTVKCNPFEEYRRENGLICKYSKKGNGTPIKSLKYYDKKLGNCIDITPEKSKNRVVLRQISPWRADIYFNLETLKYELMGLKYSDLSFEKGTGKYHISQEKYDAIREKEGIGKKSEFKFTLYRNDLILIKDTLNNCERMLRFGSKNDTSKHYVELKPLEKGTFDSEEEILPVLGKVAKSGQFIKGLNKPNISIYKVRTDVLGNKFFIKKEGDKPKLDFKNNNK

SEQ ID NO: 68 - protein, 1065 aa, Clostridium perfringens
MNKDINYALGLDIGITSVGWAVINLDLNRIEDLGVRIFNAAENLKDGSSLALPRRLARGRRRLLRRKAYRVERVRKLILKNNILTKEELEGLFKNKEVIDVWEARVKGLDYKLSREEWAKILINFCKRRGFKSNRKNEAKDKEAGQILSSISYNIEKMKETNSRTIGEYIYNEVKNSEDSYAPLRNKFGEYKMCVSRDVIREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEEELFSTLTYSIDKDISKTENTKFVSLKGYHEIKRAIEKGVSKKAWQDIENNRNLLNDIAYVLTLGKTDDEIEKQLRLRNVPEELFESLLDMSFNKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTVVEVLKYRLWEQQRGECAYTQSQIPLERLFSPGYCEIDHIIPFSRSFDDSLSNKILVLGSENQRKGNRTPYEYFGEDSERWNSFEIWVKGSYLNYKKKANLLKKKFSEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKSPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAVPFKDGIPMNEGLVAKEGMVRIDIYEKEGKYFVVPVYRYQLAKGIVPKRAAIAKKDELKWPIMDQTYNFKFSIYKNDLIEVKYDKKGVYFGYYDGFDRNSASLTIEKHDNSERYRSIGLKVGVLEINKYEVDVLGNYHKVKLGGN

SEQ ID NO: 69 - protein, 1195 aa, Elusimicrobium minutum
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 70 - protein, 1101 aa, Akkermansia muciniphila
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 71 - protein, 1187 aa, Bifidobacterium longum
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 72 - protein, 166 aa, uncultured Termite
MNKVQEIEYKKIREKLADREYRIGLDLGVGSIGYVVVSLKECNDLSYLPEDIILSGSRIFKSSIGAVERREFRLQRNSHRHHRERMRFLWQLLAEKQLALQSSKDLEKKENSADCETSQKRFPINILKEDPYILRYKALEEKLSLFQLGYVLYHIANHSNTAYENT

SEQ ID NO: 73 - protein, 1032 aa, uncultured Termite
MLYHIANHRGTDSVRSFLEYDDDKIKENTLTAKIAKETKKVIDAKKYRTFGEYLYKGKIEKFQQNIRKKVSNRKTPANKNKEFAVTRDVIIKETEKILASQKQYYTYILTDEYIKKIKDAISYQTEKLIPESGYCPYFKDEKRLPRSHKLNEYRRMYEALNNAKYFDPVLDENTGEILSYQEKEFSREEKKILFDEVLLKGMELTESGAKKLLYHLPDGCEVQLQGRDKTTQKIKGYALVDLEASPFWLRLSQQQQDEFLYDWNSLPLEKLKPKLTNYYSLTESEVDETFQEIKLPSNYASVGKKAMEILLTYIKDGCSYTEALEKAVSEGKLKVDKQTMIYDSLPYYGKILKESTQKLIGKAFSKQFADRNYKEPDTNKNEREFGKIANPVVHQTLNELRKLINEIITVFGKKPLEIGLETTRELKKSKKNREYLSKQQNKNEYARNRIYKEYIEPHLSQIKSRQENPSKYISKFELLEEQNFICPFCSEKITPDDIINSKVDVEHIFPIEESEDITKNNLVIAHNECNADKGKKSPFDAFGDKTSGKYRWNCILHNAQKNLPHKVWRFYQGSLEKFLENKPMSRRFGTDNSYISKIAARYLACLFNDPYHSEIFCIKSSLIAQLRIAWDLNSIMVPLVKNILSEKELEEFKISKNKKIRIDNRHHALDAIVIAYANRGYHNFLNRIHAKEYKINYREKSWLSKILLPPLNRDLEDFKISVKDSIEKANVSIKHDHNTNGSLVKATAYKVYYSGAGEYIITTSKNVEEISFKEKEDPKDTLYRALCKFECRDIDIKDEKLIKKLKYNSTLYKKVQNNLSKAKQELEQDNKKTEEEGKKSQKITEVRIYKKACSLVKGQYIQCGSRLKDKFFAVKEPTEIKTGLGYDTGDNLFLDLYYDKTGKLCGEIIRKVNFNRNKPNYQKEGYTLFERIYQSDILEVDTSEDRISLKNKTGSAPSDRTFIKVNTFTEVNAYFDGKRDKIQIFFGNLLKSSFKNDSFFISSMQKYNVRKVILTSLGIIKYRSQILKNKEV

SEQ ID NO: 74 - protein, 1032 aa, uncultured Termite
MKKRILGLDIGIASVGWALVEFDDEFQDNKKKGTIIKSGVRIFTRAETPKERESLAKPRREARSQRRRIRRRVERLNSIRELFVKNGVVEEWSVSKKNPNNIYITLNQIKTPWQLRMESLDRKLTNEQFAVVLTHLAKHRGYKSLRKDDKAGKVLEAISQNKKRLNDSDYRTLGEMFCKNESYKEHKRNKGGEYINSVARELIEEEVEKIFVKQREKGNNFADVNTEREYLKIAFSQKPAGSISKMVGFCTFENGEKRAPRDSYSAELFKVLCTINNTTFTDMKTGEIRSFSKEEIGKTLETVKNVKDVKYAKIRKDLGLEDSVKFSGVDYRENAKSKGEGEIFVSMKTYHEIKSKIEKLSKEKWDNLKGNTELLDSIVNIIANLKDDESIKKEFQKLKIDEDIIDVLLNFEFKKFINLSFKALRKIIPFQFQGQKYITASTSAGYSLKQEGIKNKLVPPAKENINVAVVARAFAQTRKVINAVIRKYGQFDQINIELATELKNSKFDRSKIEEGQKKFQSQKDKIFKEVQELRGGMTPSSSLLLKYRLWREQDERCVYSGRKISFEDLLDTGFLDIDHIIPYSKSMDDSFNNKVLCLAEENRNKKNDIPFNYYQRIDRDWNLLISIITSMKNMKIAKKSRLLKQELSDIEGFIERNINDTRYATRYIKDFLENNLEFKENEFIKVKVQARSGGLTSVLSYNWGMSKDREESYFHHAKDAIIVACSTQGMVQYISKISQQYENDKDKMKKIKDKTENCIPKPWDSFRADVEESIEGIFVSFAPRHKVTGSAHKETIYSKKHLEKERYVTVKKSLDKIKLSDLENIPCNENCGIIRVLKERLEKFKNDSLKAFADPVHMPTKCPNKKGPVIRSVKIKESNKTGIEVRKGLAERGEMVRVDVFIKDKKYYLVPIYVSDFKNKDLPNKAIAALKLENEWIMIDKTYSFKFSLFKDDLIKIKKKKEEIFGYFGGVHRSTGTIKIKSRHKPKEIDEGIGSRCLLDFRKFQVDVLGNYTEVKHEKRMPAYITRKDKKH

SEQ ID NO: 75 - protein, 1361 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 76 - protein, 1348 aa, Streptococcus equi
MKKPYTIALDIGTNSVGWVVVTDDYRVPTKKMKVLGNTERKTIKKNLIGALLFDSGDTAEGTRLKRTARRRYTRRKNRLRYLKEIFTEEMAKVDDGFFQRLEDSFYVLEDKEGNKHPIFANLADEVAYHKKYPTIYHLRKELVDNPQKADLRLIYLAVAHIIKFRGHFLIEGTLSSKNNNLQKSFDHLVDTYNLLFEEQRLLTEGINAKELLSAALSKSKRLENLISLIPGQKKTGIFGNIIALSLGLTPNFKANFGLSKDVKLQLAKDTYADDLDSLLAQIGDQYADLFLAAKNLSDAILLSDILTESDEITRAPLSASMVKRYREHHKDLVTLKTLIKDQLPEKYQEIFLDKTKNGYAGYIEGQVSQEEFYKYLKPILARLDGSEPLLLKIDREDFLRKQRTFDNGSIPHQIHLEELHAILRRQEVFYPFLKDNRKKIESLLTFRIPYYVGPLARGHSRFAWVKRKFDGAIRPWNFEEIVDEEASAQIFIEKMTKNDLYLPNEKVLPKHSLLYETFTVYNELTKVKYATEGMTRPQFLSADQKQAIVDLLFKTNRKVTVKQLKENYFKKIECWDSVEITGVEDSFNASLGTYHDLLKIIQDKDFLDNPDNQKIIEDIILTLTLFEDKKMISKRLDQYAHLFDKVVLNKLERHHYTGWGRLSGKLINGIRDKQSGKTILDFLKADGFANRNFMQLIHDSELSFIDEIAKAQVIGKTEYSKDLVGNLAGSPAIKKGISQTIKIVDELVKIMGYLPQQIVIEMARENQTTAQGIKNARQRMRKLEETAKKLGSNILKEHPVDNSQLQNDKRYLYYLQNGKDMYTGDDLDIDYLSSYDIDHIIPQSFIKNNSIDNKVLTSQGANRGKLDNVPSEAIVRKMKGYWQSLLRAGAISKQKFDNLTKAERGGLTQVDKAGFIQRQLVETRQITKHVAQILDSRFNTEFDDHNKRIRKVHIITLKSKLVSDFRKEFGLYKIRDINHYHHAHDAYLNAVVAKAILGKYPQLAPEFVYGDYPKYNSFKERQKATQKMLFYSNILKFFKDQESLHVNSDGEEIWNANKHLPIIKNVLSIPQVNIVKKTEVQTGGFYKESILSKGNSDKLIPRKNNWDTRKYGGFDSPTVAYSVLVIAKMEKGKAKVLKPVKEMVGITIMERTAFEENPVVFLEARGYREIQEHLIIKLPKYSLFELENGRRRLLASASELQKGNELFLPVDYMTFLYLAAHYHELTGSSEDVLRKKYFVDRHLHYFDDIIQMINDFAERHILASSNLEKINHTYHNNSDLPVNERAENIINVFTFVALGAPAAFKFFDATIDRKRYTSTKEVLNATLIHQSVTGLYETRIDLSQLGEN

SEQ ID NO: 77 - protein, 1341 aa, Ruminococcus lactaris
MGKGYYVGLDMGTGSVGWAVTDESYQILRRHGKAMWGVRLFESAKTAEERRMFRTGRRRLDRRGWRIEILQEIFAEEISRVDPGFFLRMKESKYYPEDKRDIQGNCPELPYTLFVDKTFTDKDFHKKYPTIYHLRKMLMETEDTPDMRLVYLALHHMMKHRGHFLLSGDISQVTEFKNTFNQFIENIRNEEMDFEIELDESAVQMIEETLKDKNLTRSAKKSKLVKGLNAKNVRDKAFLTLLSGGTVKLSDLFGMEELNEGERPKISFADNGYEEYAAVVEMELGELYYIVESAKAVYDWAILSDILGGSTSVSDAKVRAYEKHKADLKYLKAVVKEYFPKEVYNAVFVESSDKLNNYPAYIGMTKKNGKKVSLEGKRCSREEFMDFLKKNIVVKLPDEEAKMYLQSELEKDSFLPKQVNKDNGVIPYQVHKYELKKILDNLGDKIPFLKENAEKIEKLFSFRIPYYVGPLRTGNGENSKFAWAERKSTEKIYPWNFENVIDVEQSAENFIRRMTNKCTYLIGEDVLPKDSLLYSKFMVLNELNNLRLDGQKISVELKQKIYRDVFCRSRKVTQKKLKSYLIREGIAGKNVELTGIDGDFKGSLTAYHDFKEKLIDVELTQKEKEEIILNIVLFGDDKKLLKQRLKKKFPQLTEKQINTVTALSYKGWGRLSKKLLEEVTVPAPETGEVWNIITALWETNDNFMQLLSKEYQFSDRIEEFNEEKADPEVSYQTIEDLYVSPAVKRQIWQTLQIIQEIEKVMGEKPKRVFVEMAREKQENKRTESRKKTLSDLYTKCKKEEPEWIEALCTSLEKHEEHQLRSDKLYLYYTQKGRCMYSGEPIDLEDLWDNTKYDIDHIYPQSKTMDDSLKNRVLVKKEYNAKKSDTYPIAADIQKKMMPFWKSLLTGGFIPKEKYDRLVRNNPLDANELAGFIERQIVETRQSTKAVAEILKKILPDTEIVYVKAKTVSKFRQDFDFIKVRDMNDLHHAKDAYLNIVVGNVYFVKFTKNAAWFVKENPGRTYNLEKMFIWDVARDGEIAWKAGKSGSIVQVRAMMEKNHILVTRRSYEVKGGLFDQQILKKGKGQVPVKESDERLRDIGKYGGYNKAAGVYFMLVSSKDKKGKEQRTIEFVPIYLKDRVEKDMESARNYLMEERGLREPKILIKKIKIDTLFKVDGFYMWLSGRTSNQLIFKGANQLILSKEDMKTLKKVVKYIQRQKEDKNVKISMRDGITEEELLKLYETFLDKIRHSIYGARLSSQEKTLVNGKEKFIDLSVEAKCQVLYEILHLFQCQSGAANLKMIGGPASAGILVMNNNISKCKNISIVNQSPTGIYEKEIDLLRV

SEQ ID NO: 78 - protein, 1003 aa, Gluconacetobacter diazotrophicus
MIDESLTFGIDLGIGSCGWAVLRRPSAFGRKGVIEGMGSWCFDVPETSKERTPTNQIRRSNRLLRRVIRRRRNRMAAIRRLLHAAGLLPSTDSDALKRPGHDPWELRARGLDKPLKPVEFAVVLGHIAKRRGFKSAAKRKATNISSDDKKMLTALEATRERLGRYRTVGEMFARDPDFASRRRNREGKYDRTTARDDLEHEVHALFAAQRRLGQGFASPELEEAFTASAFHQRPMQDSERLVGFCPFERTEKRAAKLTPSFERFRLLARLLNLRITTPDGERPLTVDEIALVTRDLGKTAKLSIKRVRTLIGLEDNQRFTTIRPEDEDRDIVARTGGAMTGTATLRKALGEALWTDMQERPEQLDAIVQVLSFFEANETITEKLREIGLTLAVLDVLLTALDAGVFAKFKGAAHISTKAARNLLPHLEQGRRYDEACTMAGYDHAASRLSHHGQIVAKTQFNALVTEIGESIANPIARKALIEGLKQIWAMRNHWGLPGSIHVELARDVGNSIEKRREIEKHIEKNTALRARERREVHDLLDLEDVNGDTLLRYRLWKEQGGKCLYTGKAIHIRQIAATDNSVQVDHILPWSRFGDDSFNNKTLCLASANQQKKRSTPYEWLSGQTGDAWNAFVQRIETNKELRGFKKRNYLLKNAKEAEEKFRSRNLNDTRYAARLFAEAVKLLYAFGERQEKGGNRRVFTRPGALTAALRQAWGVESLKKQDGKRINDDRHHALDALTVAAVDEAEIQRLTKSFHEWEQQGLGRPLRRVEPPWESFRADVEATYPEVFVARPERRRARGEGHAATIRQVKERECTPIVFERKAVSSLKEADLERIKDGERNEAIVEAIRSWIATGRPADAPPRSPRGDIITKIRLATTIKAAVPVRGGTAGRGEMVRADVFSKPNRRGKDEWYLVPVYPHQIMNRKAWPKPPMRSIVANKDEDEWTEVGPEHQFRFSLYPRSNIEIIRPSGEVIEGYFVGLHRNTGALIPTPVGPDSYVIA

SEQ ID NO: 79 - protein, 1368 aa, Streptococcus pyogenes
MDKKYSIGLDIGTNSVGWAVITDDYKVPSKKFKVLGNTDRHSIKKNLIGALLFDSGETAEATRLKRTARRRYTRRKNRICYLQEIFSNEIAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVETTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 80 - protein, 1504 aa, Bacteroides dorei
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNYPNLITDDKKVPYDWTIYYLRKKGLTSKISKEELAWILLNFNQKRGYYQLRGEEEEENKDKLVEFYALKVVAVEDSGEKKGKDIWYNVHLENGWVYRRTSNMSLDWVGKTKEFIVTTDLEKDGTPKKDKEGNVKRSFRAPKEDDWSLVKKKTEADIDQTHKTVGAYIYDTLLGNPSQKIRGRLVRTIERKYYKEELKLILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIINLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSYYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNKSATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 81 - protein, 1426 aa, Capnocytophaga sputigena
MKNILGLDLGITSISFAHIVEDENKEKSEIKELGVRIVSLTTDEQSDFEKGKSITTNANRTLKHGARLNLDRYQQRRKYLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQREFDLVWNFQKQFYPDILTDSFYKELQGKGKDATSKAFSKRYHFDTAENKGSKESVRLQAYQWRAEAISKQLSKEEVAYVLTEINNNLNNASGYLGAISDRSKELYFNRQTVGQYLYAQLQENRHNSLKNKVFYRQDYLDEFERIWETQASFHKELTDELKKQIRDVVIFYQRKLKSQKGLISFCEFESKEIEIEKDGKTITKTIGARVVPKSSPLFQEFKIWQILNNVTCKRKGIRKKKSSAKSTELDLFNEPSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIKEKVKDIFQALGICTKILYFDPLLPVKEFEKQDSYQLWHLLYSYESDDSTSGNETLYRILEKKYAFKREHARILANVALQDDYGSLSTKAIRKIYPNIKENQYSKACELAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKKFGIKNPTKSDIIRYRLYQELEHNGYKELYTNAPIARDMLFSKNIEIEHIVPKARVFDDSFSNKTLTFHRINSNKGEYTAFDYITSLNSEEELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNVNKPAGTDKQQITLTPRGQLHKETIYGKYQYYVNKEEKVGVKFDERTITKVSNPLYREALLKRLQANDNDPKKAFTGKNALSKNPIYLDETKTKTLPEKVNLTYLEEDFSIRKDISPDNFKDLKSIEKVIDQGVKRILIKRLQDYDNDPKKAFVDLEKNPIWLNKEKGIAIKRVTISGVSNAQPLHIGKDHLGKTTLNKEGNEIPVDYVSTGNNHHVAIYRDKEGNLQEQIVSFFEAVVRTQQGLPIIDKTYKQEEGWQFLFTMKQNEMFVFPNATTGFNPAEIDLLDPKNKKLISPNLFRVQKIATKDYFFRHHLETNVETDNVLKNTTWKREGLSGLKDIVKVRINHLGDIVSIGEY

SEQ ID NO: 82 - protein, 1443 aa, Parabacteroides johnsonii
MIKLLYLEKLKQYTMKKILGLDLGTSSIGWALVNEAENSDEVSSIIKLGVRVNPLTVDEMQNFEKGKSITTNADRTLKRSMRRNLQRYKLRRDALIELLKKVGFITDKTILSEQGNRTTFETYRLRAKAAEEEISLKELARVLLMINKKRGYKSSRKAKGEEEGALIDGMEIAKKLYDEDLTPGQLCLQLLESGKKFFPDFYRSDLQEEFNKIWDFQKQFNLFSFCDVAKEEVKGKNKSQTWAILAKYFVETKKVNVWNEHEAQTENREEVYKLVGLKRTVKGEELKKENYRWRVQALTEQLDLEKIAVVLQEINGQISASSGYLGAISDRSKVLYFNRQTVGQYQMAELNKNPNMSLRNMVFYRQDYLDEFNVIWEKQAEFHKELTPELKKEIRDIIIFYQRRLKSQKGLISFCEFENREVVVEKEGKKQTKIIGCKVIPRSHPLFQEFKIWQTLNNIEVFVGEKKGKRKKSNVSSDLFGDTEDALITEGRRFLYQEEKKILAKELSIKKGLTKAEILRLLFENPQELDINFKQIDGNQTGFALFSAYSNMIEKYGYEPLDFKKPAEDLISQLKTVFTDLGWNTDLLFIDLDKENKEWEKQPYFRLWHLLYSFEGDNTPTGNGKLIEKIMQLCGIEKEYAIELANVSLQDDYGSLSAKAIKKILLYLKEGNQYDMACEYAGYRHSKSSLTKEEIENKVLKDKLEILPKNSLRNPVVEKILNQMVNVINTVMEVYGRPDEIRVELARELKKSAKEREELTKAVAKNTREHEEIRKVLQSEFGMINVSRNDIIRYKLYEELKDNGYKTLYSNQYIPREKLFSKEIDIEHIIPQSRLFDDSLSNKTLEYKSINIEKGNKTAYDFVKEKYGEEGLQQYLNRCENLCKDKKAKLRKLKMELNEIPDGFIDRDLRNTQYIAKKALSMLTEICRRVVATTGSITDKLREDWQLVDVMKELNLPKYEALGLVEVYEDKDGRKIKRIKDWTKRNDHRHHAMDALTVAFTKDVFIQYFNNKNAAWESDSKEHTNIVGIKTRYFESGKAVPPIPLGQFRVEAKCHLENLLVSIKAKNKVVTTNVNCIKKKGGTYKNTQQTPRGQLHLETIYGSHNQYVTKIEKVNASFDAVKIATVSKQDYRNALLKRLEVFGNDPKKAFTGKNSLEKNPIYLDRAQTIQVPDKVQTVELETAYTIRKPVDPTLNVDKVVDKKIRLILEQRLKEYGGDAKKAFVNLDENPIWLNEEKGISIKRVTIRGISKAQALHDKKDKDGNFILDETGKRIPVDFVNTGNNHHVAIYRKPVLDKKGQVIFDDEGNPMYELDEDVVPFFEAVTRANLGIPIIDKDYKKSEGWQFLFSMKQNEYFVFPNEKTGFNPKEVDLLDPDNYAMISPNLFRVQKIGLNDYTFRHHLETTIQNDLKFITWIRCGKSGIKDIVKVRINHIGQIVSVGEY

SEQ ID NO: 83 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 84 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 85 - protein, 1021 aa, Clostridium cellulolyticum
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 86 - protein, 1131 aa, Acidovorax ebreus
MAQHVFGLDIGIASVGWAILGEQRIIDLGVRCFDKAETAKEGDPLNLTRRQARLLRRRLYRRAWRLTQLSRLLKRKGLIADAKLFAKAPSYGDSAWELRRQGLDRLLTPLEWARVIYHQCKHRGFHWTSKAEEAKADSDAEGGRVKQGLAHTKALMQAKNYRSAAEMVLAEFPDAQRNKRGQYDKALSRVLLGEELALLFATQRRLGNPHASDFFEKLILGDGDRKSGLFWQQKPALSGADLLKMLGKCTFEKGEYRAPKASFSVERHVWLTRLNNLRIVVDGRSRPLNEAERQAALLLPYQTETSKYKTLKNAFIKAGLWGDGVRFGGLAYPSQAQIDAEKTKDPEDQFLVKLPAWHELRKAFKAAGHEALWQQISTPALDGDPTLLDQIATVLSVYKDGAEVVQQLRQLALPEPAASIAVLEKISFDKFSSLSLKALRRIVPLMQSGLRYDEAVAQIPEYGHHSQRIEPGAAKHLYLPPFYEAQRKYAGKGDHIGSMQFRDDADIPRNPVVLRALNQARKVVNALIREYGSPIAVNIEMARDLSRPLDERNKVKRAQEEFRDRNDRARSEFERDFGYKPKAAAFEKWMLYREQLGQCAYSQQPLDIQRVLDDHNYAQVDHALPYSRSYDDSKNNKVLVLTHENQNKGNRTAFEYLTSFPDGEDGERWRTFVAWVQGNKAYRMAKRNRLLRKNYGVDESKGFIDRNLNDTRYICKFFKNYVEEHLQLAARADGDTARRCVVVNGQLTAFLRARWGLTKVRGDSDRHHALDAAVVAACTHGMVKALADYSRRKEISFLQEGFPDPETGEILNPAAFDRARQHFPEPWTHFAHELKARLFTDDLAALREDMQRLGSYTTEDLGRLRTLFVSRAPQRRSGGAVHKETIYAQPESLKQQGGVIEKILLTSLKLQDFDKLLNPESNDHFVEPHRNERLYAAIRQRLEQFGGRADKAFGPDNLFHKPDKNNQPTGPVVRSIKLVRGKQTGIPIRGGLAKNDSMLRVDIFTKAGKFHLVPVYVHHRVTGLPNRAIVAFKDEDEWTLIDESFAFLFSVYPNDYVKVTLKKEQQSGYYSGADRSTGAMNLWAHDRAASVGKDGLIRGIGVKTALSVEKFNVDVLGRIYLAPPETRSGLA

SEQ ID NO: 87 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWGEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 88 - protein, 1509 aa, Bacteroides coprophilus
MKKTLGLDLGTNSIGWAVINSNIDSEGKEKLVGISSCGSRIIPMDATTLGDFGKGNTKSPVAERTRLRGIRRLLERSLLRRERLHRVLSVMGFLPEHYASQLDRYGKFLPETEPKLAWYKDDSGRYQFLFQKSFHEMLEDFRQHQPELVAGEKKIPYDWTIYYLRKKALSQEITKEELAWILLNFNQKRGYYQLRGEEEQEENNKSVEYHALKVVSVEDSGERKGKDIWYNVTLENGWVYRRASNIPLDWTGKVKEFVVTTELDDAGNPKKDKEGNVKRSFRAPKEDDWGLLKTRTQAQIDESGKTVGTYIYESLLCMPNQKIRGKLVRTIERKYYKDELRQILVKQSEFHAALQDHNLLLSCIEELYPNNEAHRRLLSASSFIYFLIEDILFYQRPLKSQKGLIDNCPYESHIYKDKKDGSLHHVPLKCVSKSHPLFQEFRLWQFLSNLRIYQRERMMDGSLKLDVDVTREFLPSEEDYVKLFDWLNERKEISQKFLLAYKPFGLKKNEQANYRWNYVEDKSYPCNETRAEIKSRLSKAGVPEEFLTEEKEEALWHILYSISDKKELTKALGTFAAKNCLNESFVEVFAKIPPFESNYAAYSLKAIRKLLALMRMGKYWNEQAIDRQTRDRIEKILTGEYDETIRSRVREKAMLLTDISSFRGLPLWLACYIVYDRHSESKELVKWETPADIDHFLSKFKQNSLRNPIVEQVITESLRTVRDIWKQEGKIDEIHVELGREMKNPAKERARITAQVQENENTNLRIKALLAEFMNPEFEIENVHPYSPGQQEILRIYEDGVLSGIAEKDLPDDITAILKKFRENDVKKRPTTSEVLRYKLWLEQRYRSPYTGRVIPLGKLFTPAYEIEHVIPQSRYFDDSISNKVICESAVNKLKDNCLGYEFIKKHSGEMVELGNGETVPVFSVEEYERFVKESYFGNSKKMKKLLLEDIPDSFIERQLNDSRYISRVVTSLLSNLVCEEGEQDGLSKNVIVCTGGITDRLKKDWGVQEVWNRIILPRFLRLNEITGRTDFTSTSVNGHLLPALPLYLQKGFNKKRIDHRHHAMDAIVIACANRNIVNYLNNSSARKNSEISRYDLQRLLCEKVKTDANGNYKWILRKPWETFTQDVYAALTNIVVSFKQNLRVINRTTNYYQHYNEAGEKRMIPQTKGDRWAIRKPMHKDTVYGEVNLRKEKTLPLRDVVKNPSIVVDKSLKNKLYELLKSQYDLKAIAKYFETHQDVWADVNLKKIKVYYFTKETNERFFATRKSLDPSFDQKKIEEEVTDTGVQKILLHHLQQNNNDPDMAFSPDGIDRMNQNMTILNDGKWHQPIYKVRTYEKADKFAVGESGNKAKKFVEAAKGTNLFFAVYESVQEDEAIGKQVCKRTFATIPLNEVIKRKKQGLPAAPEDLNGNLPKFVLSPNDLVYLPTEEERNSSRIIQPLDRERIYKMVSSSGSQCFFIKVFVANSIWDKNEYSSLNKMERAITNEMIKEICVPIKIDRLGNVSLIQI

SEQ ID NO: 89 - protein, 1219 aa, Bacteroides cellulosilyticus
MKEEVRGKNRSQTWAILAKFFVWSEKESVWNEKEARTEERVKEYKLVGLKRDTKGNELKLENYRWRVQALSEQLNPEIVAIVLQEINGQISASSGYLGAISDRSKQLYFNRQTVGQYLMSELEKDPNVSLRNRVFYRQDYLDEFDRIWEKQAEFHEELTVELKKEIRDIIIFYQRRLKSQKGLISFCEFEKREVVVEEDGRKKNKTVGCRVIPRSHPLFQEFKIWQTLNDIEVFAWDKQSKRKKADKSSILFDNSEDALLVEGKRFLYQEEKELLAKELFVKESMKKAEVLKLLFENYQELDLNFKQIDGNHTGFALFSAYSKMIEKYGYEPVDFKRSADEIIEKLETIFTNLGWNTELLSIDLSKEDKELERQSYFRLWHLLYSFEGDNTPTGNGKLLEKIMQLCDVEKEYAVELANVSFQEDYGSLSAKAIKKILPYLKEGNQYDVACDYAGYRHSRSSLTKDEIENKILKDKLEILPKNSLRNPVVEKILNQMVNLINTLIDTYGKPDEIRVELARELKKNAKEREELTKSIARNTREHDEIRQLLRTEFGMMNVSRNDIIRYKLYEELKDNGYKTLYSNEYIPREKIFSKEIDIEHVIPQARLFDDSLSNKTLEYRAINIEKGNKTAYDFVKEKYGNDGLEKFLNRCETLFKDKRTKLRKLKMEEKDIPEGFIDRDLRNTQYISKKAFAMLNEISRRVVATTGSITDKLREDWQLVDLMKELNLPKYEKLGMVEMFEDKDGRKIKKITDWTKRNDHRHHAVDALTVAFTKDVFIQFYNNKNAAWMPASKEHANITGIKARYFENGKALAPMPLAQFRAEAKRHLENLLVSIKAKNKVITSNVNRTKNKNGENRKLQQTPRGQLHLETVYGSHRQYATKIEKVNAAFDVTKIATVSKLAYRNALLKRLEAFGNDPKKAFTGKNTLEKNPLYLDENQTEMVPEKVQTVEFETVYTIRKPIDPNLSIDKVVDVKIRSVLEKRLKEYGGDAKKAFVNLDENPIWLNEAKGISIKRVSIRGISNAQSLHEKKDKDGNLILGKEGRKIPVDFVNTGNNHHVAIYKKPVLDKVGQVVLDEEGNPKYELDEVVVSFFDAVTRANLGQPIIDKDYRRSEGWQFLFSMKQNEYFVFPNDKTGFNPKEVDLLNPENYALISPNLFRVQKFAYKNYVFRHHLETTIKDTSSTLKGITWTDFRSSKGLDKIVKVRVDHIGQIVSIGEY

SEQ ID NO: 90 - protein, 1329 aa, Catenibacterium mitsuokai
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 91 - protein, 1152 aa, Roseburia inulinivorans
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 92 - protein, 686 aa, Coprococcus comes
MKKQDSPKNNMGYTAYNLNVLGYEEFAKRVELLFKDTDAVKRLNDSHMQMAEGFDLNALPGSPALRRGVSQAIKVLDDIVSVAGKAPDRIYLKVTRTASNSRKGKRTAKRSDKIKQALKALDADAAADLGAAKLLRELGMFDEKEINERIYLYFHQAGKCLYTGKPIDITRIASNDYYVDHVVPLAYRKDESLDNKVLVYAEASRYKSETLLVSPAVQRKMLPFWRMLRNAGLMSERKLNALIRTEISEGMLKSIIGRQFTENSWEAKLFTAAIAAKYPGTVVIPVKAGVIGAVRSRIGIPKSLKANQFYHAHDALLAAEVGRYMELAKPAFVHNRVKYEQYMRKIKLVNEENKKAPKSQLDFFAGGFFFDRVDKDTGEVYWNKDEEVERIYRACGWKNLRVTYAAFEDGGAFWKQTIYSPREKSKLIATKSDRPAEIYGGYSSQTFANFFVYEVMKKKVKQLRFGAVPAAIASKSDPDTYNAMLEMYARGLAKTAKEKFVRIVRARVLKNTMIELYGERFRIAGEKQVYPVRQMPLAIDEVYLLKGVETIAAAGNAGASAKIDFEKAAESLVGFWDLLLEKLPVNYPKLTVQLKLGLLKHPKDILAATSESEFPAIVYKIAEAEIQVMEQASGLRNMSDTKILGGNTFGGSLVFTFNKVLNDPKSKACFIDTTPAGLYEVKTKIW

SEQ ID NO: 93 - protein, 1105 aa, Actinomyces coleocanis
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 94 - protein, 1361 aa, Anaerococcus tetradius
MGNYYLGLDIGTNSVGWAVTDENYNIERFKKKNMWGIRLFDEAKTAESRRIHRQARRMRQRKIQRLNLLMELFDVEISKVDESFFIRKKESDLHYEDKSQDSRYALFNDKEFNDKDYHNKYPTIFHLIMDLIENDEKKDIRLLYLACHYLIKNRGHFIFEGQKFDVNSSLNNNINKLKSHLDQFYNICLDFDNDKLIEILVNQNLNISEKSKKIKELLRKTNLEVGIANLIAGGSIKLSNMFDDDELKNLDYNSLSFKNSNFDEGRELFEEVLEDRFELVEILKDIHDASVLETMLSSASISPDGGKYISSSMINSYNKHKRDLKLLKKIIKKYKKSEYDNIFRDENIKNNYLSYTRTGINKNKKVQAEDNTDSDGFYKYIVKILKDIKENDSDEDIKYILSEIDKKNFVPKQRTKENSVIPYQLREIELRKIIDNQSKYHKFLNEVDEKGISVKEKIISLLTFRIPYYIGPLNPSYNEEKNFTTSWVKRLAKGKVTPWNFEDMVDIDASREAFIENKLNKCSFLLDETVLPKDSLLYQEYMVLNELNNLKINGQSINTDLKKSIYEELFKKYKKVTRKRLISYIKEKENMSGDIVITGIDGDFKQGLKSYIAFKDIIGEKIDDDIYRKEVEKIIRDISLYGDDKSFIQKKIKNENKLDLSDDQISKIAKLKFKDWGRFSKKLLVGIKASDKNTGEIDNIIGFMRNYNYNIMQLMANVFTFKDEIEKLNSKYYTDEKINIDYLDDLYLSSPAKRMLWQSFQIVDEIKNIKNSDPKKIFIEMARSKEDKPTRKMSRKSRLEKLYTDSKKQFIKLFGPDEYDKLNNEIKNKSESDFRWDNLYLYYTQFGRCMYSLDPIDLEELSNKNLYDQDHIYPKSKIYDDSIENRVLVKKQLNLDKSNEYPIPDRVLNKDKNKLLAFWKMLNEKELIGDKKYARLIRKSPFTDEELGDFIARQLVETRQATKETANMLKRLCPDSKIVYVKAKNVSDFRRKFDILKCRSINDLHHAHDAYLNIVVGNVFDTKFTSNPLNFIKNNSKNRSYNLEKIYDYDVIRNEKIAWLAERKEENQDGSIATVLKNLSKNDIRVTRRTYIKCEDLFDENIVRKGNGKFPIKENNNKSDTNKYGGYSGIKNAYFVLLEDEKHNRILEAIPSFIYKKEKNGEKGSVINYLQNILGIKSAKILRDKIKIGSLLKIDKFPYNLAGKSGNGILISGGVQLILDKNTSKYIKKIENYKYKLDENKDYQINIFDKLSKEENIKLFDLFVDKFENSIYKNRVNIKLKEIKLARPKFEHLSIEEQIKTLTQMLILFGRENNAVNLEYIGLPKNTGKTKINKKINNKDIKIINQSITGLYETEEDLANI

SEQ ID NO: 95 - protein, 1377 aa, Lactobacillus brevis
MESNHDGEQVKYTLGLDIGTSSIGYAAIDKHQKPIRAKGKHVIGVRLFQEGQTAADRRAFRTTRRRLKRRKWRLNLLNRLFDPYLSEVDPNFLPRLRQSNLSPKDDNKHFNGSTLFPDKTDAAFYRQYPTMYHLRYALMTEKRKFDIREVYLAIHHIVKYRGNFLNSATVDSFKTSNIDFTSQFDRLNELYRQVILDEPFQINMDQVDEMTNKLLDNDALKLDTQKQVAKLLPVIYNDKPIDKQYTRIATEFSKAILGYKTKLDVILNLDTQNAKDWVIRLDDEDIDDKLPALVENLDESRQEIVTIIRDLYAQITLNAIVPKGKSLSESMVDKYNDHKDHLDLLMGLIHELGDDSAKGIKLREAYTQYVGKSDDKTLNQDDFYAAIKKNLDEDSKRSPKIQRLIEQASFMPKQRTSANGVIPHQLHQLELDRIIENQGRYYPFLKKPNPNTHKPNGGKYKLDELVAFRIPYYVGPLITKRDQEKTSGADFAWMIRKPGQEGEITPWNFDQKVDRMASANRFIRRMTTKDSYLVAEDVLPDASLIYEKFKALNELNMLKVNDSRLSPSQKQDLFNNLFKKQKTIRTKKLQTYIRTNWELPSVMISGLADPDKFNSSLSTYIDFRDIFGEKVDDPNRQADYEEIIEWSTVFEDRKIYQAKLNQLDWLTEPQRKALLTKRYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSLENNPQRTVSRQRQLQAAYKNIPREIMKSGLMAELGSVADSKKVLSDKLYLYFTQMGKDMYEDKTINIDNLPNYDIDHILPQAFIKDDSIDNRVLISKEENARKSNRVPLKFFGAKRMGFWKDLLNNGLISNRKFQNLTTDPEKISKYSAKGFIHRQLVETSQVIRLVANILGNEYSQAGTTIIEVSAKMNRQLREDFHLIKNRNVNDYHHAMDAYLTAYVGDYLYLRYPKLRPYFVYGDFKKAEDQDLNIRNFNFLHDLKDNESLDKIVDSETGEIVWEKHGSVKQLKKVYHYKFMLVSQEVYTRQDALFNQTIYPASDADKRKLIPIKNSKPVDVYGGYSGNIDAYMAIVRVHGKKEDNYKVVGIPMRAVTKLKKAEKEGHDSYLNAVHEVLKPQFTKKKKNRKTGEITETVDEFDVLLGKVYYRQLIVDGNKKFMLGSSSYQYNAKQLVLSDKAMQVLSKNGKVKSQDENQNLIDVYDEILEKVDQYFELYDQRHYRESLHKGRGIFVNLPLSNQYDGSKLTSYGKYETIDAILNGLHANATMSNLRYLGISSPFGKMQASNGLTIDPDSIICYQSPTGLFERQIKLSDL

SEQ ID NO: 96 - protein, 1239 aa, Lactobacillus buchneri
MTEKRKFDIREVYLAIHHIVKYRGNFLNSATVDSFKTSNIDFTSQFDRLNELYRQVILEEPFQINMNQVDKMTNKLLDNDALKLDTQKQVAKLLPVIYNDKPVDKQYTRLATEFSKAILGYKTKLDVILNLDTQNAKDWAIRLDDEDIDDKLPALVENLDESRQEIVTIIRDLYAQITLNAIVPKGKSLSESMVDKYNDHKDHLDLLMGLIHELGDDSAKGIKLREAYTQYVGKSGDKTLNQDDFYAAIKKNLDEDSKRSPKIQRLIEQASFMPKQRTSANGVIPHQLHQLELDRIIENQGRYYPFLKEPNSNTHKPNGGKYKLDELVAFRIPYYVGPLITKQDQEKTSGADFAWMIRKPGQGGEITPWNFDQEVDRMASANTFIRRMTTKDSYLVAEDVLPDSSLIYEKFKVLNELNMLKVNDRRLSISQKQDLFNNLFKKQKTIRTKKLQTYIRTKWELPSVMISGLSDPDKFNSSLATYIDFRDVFGEKVDDPNRQADYEKIIEWSTVFEDRKIYQAKLNQLDWLTESQSKALLTKHYTGWGRLSKKLLTGLKDQNGDSILDQLWKTNDNFMQIQSRDEFAKQIHDENAKQFHEANNVDDILDDAFTSPQNKKAIRQVDKVVQDVVKAVGYAPDKIAIEFTRSPQDRPQRTFSRQRQLQSTYLNVAKALMKSNLNQELKSVIDSQQTLTDKLYLYFTQLGQDMYTGKEINFDELVNYQIDHILPQAFIKDDSLDNRVLVSAPINNAKSDNVPVKKFGAKMGYFWKQLAENHLISKRKLNNLTTDPDKIGKFTAQGFIHRQLVETSQVIRLVANILGNEYGHDGTTIIEVTAKMNHQMRKDFDLIKIRDVNDYHHAMDAYLTAYVGDYLYLRYPKLRSYFVYGDFKKLKDQSLKIRNFNFLHDLTNDEAGDKIVDQETGEIIWDKHESVKQLKKVYHYKFMLVSQEVYTRQDALFNQTIYPASDADKRKLIPIKNNKPVDVYGGYSGNVDAYMAIVRIHGKKEDKYKVVGVPMRAVADLKKAESKGRDNYLNAVHEVLKPQFTKKKKDRKTGEITEMMDDFDVLLGKVYYRQLIVDGNKKFMLGSSTYQYNAKQLVLSDKAMQVLSKDDKLKNQDENQNLIDVYDEILEKVDQYFELYDINKFRQKLHDGRKKFIELPVDNDFNGKKLISYGKRATIISILNGLHANATMSNLKYLGISSPFGMLQVPNGIILSPASRICYQSPTGLFERKVKLSDL

SEQ ID NO: 97 - protein, 1381 aa, Lactobacillus fermentum
MDYVKEYHIGLDIGTSSIGWAVTDSQFKLMRIKGKTAIGVRLFEEGKTAAERRTFRTTRRRLKRRKWRLHYLDKIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIVKYRGHFLNNASVDKFKVGRIDFDKSFNVLNEAYEELQNGEGSFTIEPSKVEKIGQLLLDTKMRKLDRQKAVAKLLEVKVADKEETKRNKQIATAMSKLVLGYKADFATVAMANGNEWKIDLSSETSEDEIEKFREELSDAQNDILTEITSLFSQIMLNAIVPNGMSISESMMDRYWTHERQLAEVKEYLATQPASARKEFDQVYNKYIGQVPKEKGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKAGDVASLVMAKTRGVNKPSVEGLSDPKKFNSNLATYLDLKSIMGDKVDDNRYQMDLENIIEWRSVFEDGEIFADKLTEVEWLTDEQRSALVKKRYKGWGRLSKKLLTGIVDENGQRIIDLMWNTDQNFMQIVNQPVFKEQIDQLNQKAITNDGMTLRERVESVLDDAYTSPQNKKAIWQVVRVVEDIVKAVGNAPKSISIEFARNEGNKGEITRSRRTQLQKLFEDQAHELVKDTSLTEELEKAPDLSDRYYFYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKNRPVDLYGAYTNGTSAFMTIIKFTGNKPKYKVIGVPTTSAVGLKRVGKPGSESYNQELHRIIKSNPKVKKDFEIVVPHVSYSQLIVDGDCKFTLASDTYQHPATQLVLSKESMEIIADDFKFVKENPATADEQLVRVFDEIVNQMNHYFTIFDQRSNRQKVTKARDKFVSLPTESEYEGAKKTQVGKTEVITNLLMGLHANAAQGDLKVLGLSTFGFFQSSGGLNLSEDAMIVYQSPTGLFERRICLKDI

SEQ ID NO: 98 - protein, 1306 aa, Sphingobacterium spiritivorum
MKHILGLDLGTNSIGWALIKQNFENKQGEILGMGSRIIPMGAELSKFEQGQAQTKNANRRIARGTRKLNKRYKQRRNKLIYILQGLGMLPDQIKLVNQFSDPNKLDKISILPISKNQQQLTAFDLLELRVKALTEKIELEELGKVIYKYNQLRGYSGGNSEPEKEENNEDESEENEKTNDSFVVFSKVLSLGLPEEITFKGKKLSKRKIAIETEDGIIEAETFLDSLKENDSLELHVNIRRAKSGDTITIKLPSKTSWRKKMENIEKQLADKSKELGREYFISELLFDILKENKWAKIRNNVILRSRYESEFDAVWSEQSKYYPILNHLETDRLQKILEFIFPGQKESQEKLRQTGLKEGLKYVIKNQVVFYQRELKDQSDLISNCRYEPTEKVVAKSHPVFQEYKIWEQINKLVINTKIENGVNRKGEIRYKYIDKPIPVALKEWLYEELQSKKEVSFNPILTKLKKEFKLRENVDFLNGMNAKDKLKGNETKVILQKALGELWNIFGLDDSERQVELWEILYNGKGNEYDLTSERTSNILAFIEKYSPDLENKNDVAIKISKIKFSRNYSNLSLKAIDNILPLVRAGKFFDQNFSEALSHKIVKLLNENVEDPFEKSAQEFLDKNQDVLSDGGIVNAIATILVYDKHTAKEYSGDELIKEFTQISRLKQGELRNPLAEQIINEALVIVRDIWRKYGFKPDEIRVELARELKNNAVERGKMYSANLKSQKHNAEIRNKLIELKQEISIANIEKYKLWVSQENLQEVYLKNYNDPSKSEIEKLKLWESQGHISPYTGQPISLSELFNRERYDVDHIIPQSRYFDDSLSNKVICEKSINNEKGNRTSMEYFEVGSVNYRIFTKDQFIDHANKYFSGKKRKNLLATSIPEDPIQRQIKDTQYISIRIREELNKIVGNENVKTTTGGITDYLRNHWGLTDKFKVLLKERYEAVLPKIAQLEYDNYKKETEKKFTEYKNADVEFNEPILDEEIFIEKFRSEFIRKKNNKLIIKGWSKRIDHRHHAMDALVIACTQPAHIKRLNDLNQVLKEWLDKNKEKFFPGFSGTKTELLDEVLNLEEEKRREIFNQLEKFRAIEMPWKGFPEEAEQKLKEVIVSHKPKDKLLLQYDIQGNKQIKLRGQLHEGTLYGLSNGKEIYRIPINKLAGKQFATEKTIEKIVNPFLKNVIEEHLKSFGKKEEAFSAEGILDLNKKLAERKDEQQNPKPHPPISTIKIYYKDPSKSKKKKTDDEDDISLQKLNRKKSFNDSLYVKTGDNYLFAVMEKEVFNKKLNKDKTERHYDLKLFLTLLIF

SEQ ID NO: 99 - protein, 1358 aa, Acidaminococcus sp.
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 100 - protein, 653 aa, Oribacterium sinus
MELINSEEFTFKEELEKHTQVAMKQLSEFTYEDLEDSYFSVPVKRMIWQTLLVVREIEKVMGYAPKRIFVEMTRTEEEKGDKGRKESRGNQLLELYKSIKNTDSHNWKEEIAAADKDGKLRSKKLFLYYMQMGRDMYTGEEIDLGRLYDDNLYDIDHIYPRHYVKDDSIMNNLVLVNRRANQDIKKDLYPIPEQIKANPNVHMLWDALHKQKLITDEKYARLTSNTAFSEKQLGDFIARQLVETGQGTKGVADLLEQLFKDTVIVYAKASNVSDFRRDNGFLKSRLVNDFHHAQDAYLNIVVGNVYYTKFTKNPWNFICKDYEKDKEKNRYNLARMFDWNVVRGSETAWIVERKDEKGTISTVRKMMQKNTPLLTRMNFEQHGSIANATLYSAKKAKSENYLPLKTADEKMSDVKKYGGYTSMSIAYYFIVHHKEDKKENVTIEALPLYCKDKVEREENGLEKYCEEVLGYGEVNIIRRKLKIQSLLEFNGYQVHLSGKTGNQLILRNAISLCLSTKWITYIKKLEKAVNIQIVEEVVTPEENIKLYNLLADKHANTVYSKRPNAYGEKLLADREIFVTLEFGKQCEALLQILSLTKIGSTEANLLLIGESEHSGKILISKNLKASDRPAVINQSPCGLYEKKEWIFDKIVEK

SEQ ID NO: 101 - protein, 1436 aa, Capnocytophaga gingivalis
MKYIKYILGLDIGSNSIGWALIQLDLLQKTKRIIAAGSRIIPMDQKVLSDFGKGITISPTAQRTSYRNARHCRERHLLRRERLHRVLHILGFLPTHYDKQIDFSKRYGKFVDNTEPKIAYNEGKFLFMDSFQEMLSDFKSHQPDLFYTKKNGEESKIPYDWTIYYLRKKALSQKISKEELAWIILNFNQKRGYYQLREEEGNKENDFEIISSKIISVIKKDKDKKYNKYWYDIILENGLVYQAAFYNDFVYNWINQDREFIIERTSLKNGAEKVKLSYLPTFDEIDKMDKKEQDKYYKKIKIKTENSIGNKTVGCYIYDHILQNPNEKIKGKLVRTIERKYYKEELKAILEKQIALQPELFTDQLLADCIRELYSKNEAQQRNLAARDFVHLLVEDIIFYQRPLRRQKSTLANCSLESRSYIDKDSHTRKEAPLKVCPKSNPYYQEFRVLQWLQNLKIYEIDSDQEVTHQFIKTLEDKQQLFEFLMAQKEIDCEELLKYFLNQTYPNAKEKALKSELKKWKDTYRWNYVYDIGEKSSKKYPMNETRYELKRHLEKVANLPDDFLSSEVEYLLWHLIYSVKDKVAYEKGLKKFAQKHHLDKDSFVESFKKFNPYPSEYGSFSEKAIRKLLPLMRFGAHWDFNHIDKNTQKRIEDLITGVENEEIRTILREKAEKYQLEKETDFQDLPLWLAQYIVYNRHAEASSLEKWTSVNDLETYLNEFKQHSLRNPIVEQVVMETLRVVRDIWQQYGQGQASFFNEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSKENKTIKIFTEEQYRTFIKEHYSNNPEKTKKLLLEEIPEKMVARQMNDTCYISKFISEILSKIVRSDEQDEGVHSKNVILCTGKITSILRQDWGLNDIWDNLILPRFERMNNLLQKEKFTIYSIEKQKKIPVVPINDQFKSFQKKRIDHRHHAMDAIIIACTTREHINYINNQHALEKEKDKKEKQEERDKLREKLCIKKYNNRSEGNYSWIFKKPWDTFTQEVRVALEDIVVSFKQNLRVINKATNYYERWVEENGKYIKKMVKQEGTNWAIRKPLHEETISGKIYLDREKITKNDILTATRKTVDSSFDDKRIKKITDTGIQKILLNYLKYKGSPEIAFSPEGLEELNKNLSIYNDGKPHKPIYKVRIYEKGSGRFALGEKGRKYKKYVQGASNLYFGIYQGAKRSFATIPLNEVIERQKQGLPSVPEYNEKGDLLLFSLSPNDLVYVPIEGEIIENIDFRNLSKEQKERIYNVNDFSSTCYFTPNRIAKAIFPKEVDLQRKGDKLSGSYDTKTASLEGIQIKEVCIKLKVDRLGNISKA

SEQ ID NO: 102 - protein, 1069 aa, Bacillus cereus
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLQVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 103 - protein, 1391 aa, Lactobacillus jensenii
MKEIKDYIIGLDIGTNSCGYVVTDKQNNILKLKGKTAIGARLFKEGEAAADRRAFRTTRRRLARRRWRLSLLEEIFDEEMNKVDPSFFRRLKESDYSPKDRRKQFNSIVFESSEADKAFYEKYPTIYHLRNALMHDNQKHDLREIFLAVHHIVKYRGNFLREDSVKAFKAAKFTLQGEDGIGPVDKLNDLLKEIYIEAAPELATDNLSKIEDIIKDKKLYKQDKLKQIANLLPKAVDSKDKAKLNKDIAKQVANALMGYMFRLDTLFSFTDVDVKDYKLKFSDANIDESLDALTSLLTDAQIEFVLELQSIYNTIVLNEIVPDGMSLSESMVKKYDDHKKDLKLYKEYIDSLSDQKKAKQLEAAYALYVNYRKADLLAAKKLFEKKKIGDKKFVDVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNFEEMVDTTESANQFIKRMTRKDTYLLAEDVLPKSSLIYQKFMILDELNRIKIDGKKLTSKLKHDIFEKLFKKQKSINLDNLKNYLLAEGNIPGLIEGLSDGINFNNSFSTYIDYRNIFGDEIDNPNKQADFEKMIEWSTVFEDRKIFKRKLKEITWLTPEQIKQVSSKRYSGWGRLSKKLLTQITDENGVNILQRLWNEPETLTEVLANPVIKRKISEANSLFVQINKVENILDDAYTSPQNKKAIRQVIRVVDDIIAAAHGKKPSQIAIEFARSSQNKAKVPDTRKKQLDKIYNKISSEILDSSIKNELKNLKSNKYLSKDKLFLYFKQMGRDAYTGDKLSLDQLQNYDIDHIFPRSFIKDDSLDNRVLTQKPINAKKSDYGIPALEFGNKYVPDLGITVKEMWKLWQENGLISKSKLINLCTNPKKIGSKRASGFINRQLVETSQVIKLVAIILQAEFPDTEIIEVKALQNTTLRESFHLYKNRSVNDYHHAIDAYLTTIVGNYLYQVYPKLRPYFVYGQFKKFNQEKNIDILKRLKNFNFLRQLIFNTDDNIYISGTKEIVFNKKDIIHKLETAYGYKYMNISRECYQETSSLFNQTLYAHNSSVKNSLIPKKKGLPTEIYGGYSGNKDSFFVLVKIVKKRTNLYRIVGIPTRELAKLNSSNNYNQALNKIVESKLCLKETESFKILIKRLLYGTLIVDNGQKFRIGSFKEKHNVQQLVLQLKSMKYIKFYIDGGQNYFTDVERKKLEKQDRDKCLLYVFDDIMNVVNKRFTLFDMSKYEKDGDSLREKFNCLDFNDKVSILSDLLKAFHANSDRTSITKLKITNLGRHQAGKNGITLTTNAQIIYQSPTGLFERRIKIKDL

SEQ ID NO: 104 - protein, 1114 aa, Eubacterium rectale
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 105 - protein, 1362 aa, Lactobacillus paracasei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKGYPVDIYGGYFRENTAYLAVVKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 106 - protein, 1056 aa, Actinobacillus minor
MKALNYILGLDLGIASVGWAVVEIDQNELPIRLIDLGVRTFERAEVPKTGDSLALARRLARSSRRLVRRRAVRLLKAKRLLKQEGILQADDFHSSHLKPLPNNPWELRVKGLNHLLDRKEWAAVLLHLLKHRGYLSQRKNESKTDNKELGALLKGVSENRQLLQAQAFSTPAEIAIKKFQQEEGHIRNQRGAYSHTFDRNDLLAELRLLFQKQREFNNPYTSQSLEQAIAELLMWQKPALSGEAILKMLGKCTFEPSEYKAPKNSYSAEYFVWLTKLNNLRILENGADRGLTAEERQLLINQPFEKAKFTYAQARKLLELSDLAIFKGVRYGKDNAESATLMEMKAWHAIRKALESNGLKTEWNGLKTKPELLDKIGTAFSIYKTDEDISQYLNGELSPAVLNALLENLSFDKFIRLSLQSLAKILPLMEQGLRYDEACKQVYGDHYGKKEQLELRFLPKIPVEDIRNPVVLRTLSQARKVINGVVRLYGSPARIHIETGREVGKSFSERRDISKRQEENRNERQRAVEKFKEFFPHFVGEPKAKDILKMRLYEQQHGKCLYSGKELDLNRLLEKGYVEIDHALPFSRTWDDSFNNKVLVLASENQNKGNQTPYEWLNGKENAERWKLFQALVNGSRFPYSKKQRILTKYLDEDGFRERNLNDTRYVARFLCNFIEDNMQLVGQGKKRVFASNGQITALLRRSWGIQKVREDNDRHHAVDAVVVACSTRALQKKITDYVRYKEMNVFTGEKIDQETGEIIKFHFPEPWKFFRQEVEIRVFSETPAEDVVIALPDRPQANHEFIQPLFVSRAPTRKMTGQGHMETIKSAKRLAEGLSVSRVPLTQLKLKDLENMVNREREKALYEALKVRLEKFNNDPAKAFADPFYKKGGQQVKAVRVEQVQKSGVLVRQENGVADNASMVRVDVFIKGGKYFLVPIYTWQVAKGILPNRAATQGKEEEYWDIMDETAIFQFSLYQNDLIKLVTKKKTIFGYFNGLNRATSNINIKEHDLDKSKGKDGIYLEVGVKLALSLEKYQVDELGKNIQPCRSMKKRPPVR

SEQ ID NO: 107 - protein, 1081 aa, Neisseria flavescens
MTAFKPNPINYILGLDIGIASVGWAMVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELAVNKFEKESGHIRNQRGDYSHTFSRKDLQAELVLLFEKQKEFGNPHISDGLKEGIETLLMAQRPALSGDAVQKMLGYCTFEPTEPKAAKNTYTAERFIWLTKLNNLRILEQGSERPLTDTERATLIDMPYKNKLTYAKARELLGLDDTAFFKGLRYGKDNAESATLMEMKAYHAIRRALEKEGLKDKKSPLSLSPELQDEIGTAFSLFKTDEDITGRLKGCLQPEILDALLKHINFDKFVQISLKALRRIVPLMEQGKRYDEACAETYGDHYGEKNSEEMLYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKAIDIRRLNGKGYVEIDHALPFSRTWDDSFNNKVLVLGSENQNKGNRTPYEYLNGKDNSREWLEFKARVETSRFPHSKKQRVLLQKFDEKGFKERNLNDTRYVNRFLCQFVADHMQLTGKGKRRVFASNGQITNLLRGFWGLHKVRAENDRHHALDAVVVACSTVAMQQKITCFVRYKEMNAFDGKTVDKETGEVLHQKTHFPQPWEFFAQEVMIRVFGKPDGKPEFEEADTPEKLRALLAEKLSSRPEAVHEYVTPLFVSRAPNRKMSGAHKDTLRSAKRFVKHNEKISVKRVWLTEIKLADLENMVNYKNGREIELYEALKARLGAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLMQKYQIDELGKEIRPCRLKKRPPVR

SEQ ID NO: 108 - protein, 1392 aa, Gemella haemolysans
MANKTWYLGLDIGSASVGWAATDTGYKIIRKNKKRLWGVRLFEEAKTAEDRRGYRSSRRRLARRKWRLNLLEELFTSEVKKVDENFFLRLKESQYHYEDKTHKVPYAIFNDKDYTDKDYYKDYPTIYHLRSKLMTEENPDIRKVFLAIHHIIKNRGHFLLQGQSFKDGNLNNLIKELLELDILHVGFEVTEEVVDKIADISLEKKTSKDKLNDIKELYPKEKQLLEVFRLIFGGKTSLDKLFAIDEYKELDAAIKSVSFKEKIYEEVRHDYEQVLSNYIELLDLAKLVYDSIILSDIKKEGKTLSESKVELFEKHRDDLLKLKNLVKNDSKLSEDKKVELYALIFKEDKDKGTNYVNYIRKSEEGKGCNYEDFKKFLVKELAKLEESSVKTEIIKDLELEQFLPLQRTKDNSVVPYQIHKEELVKILDNAARYHSFLNEKDESGYNVREKVIQLLEFRIPYYVGPLNSSKKAKEGGFAWSVRNTGYENTPVTPWNYSKVIDESASAEKFITNLTNKCTYLKGEDVLPKSSLLYSEFALLNELNALKYDGNRISLEARNTIIEKLFKQQGKKVTKTSIKNLLKAEGYIDGKGEITGIDITVKNDLKSYRDFKKILGNKFNSEHVENIILWITLYGESRKLIKAKIESVYGEVYSKDEITKMSRLVYKDWGRFSRKLLTELVSKKLYNEETGECLNIIGAMRQNNILFMELLADRFDYSKQIVEFNKELQEDVTEIAPEILDDLYVSPAVKRSIWQTVRIVEELKKIIGCAPAKIFVETTRSNQEKKKPTDSRKKQLELAYKAVKKDVKELEKEIGTINFDVLNDRLSSVEPSKLKAKKLYLYYTQLGRCMYSEEPINISELFDNNKYDIDHIYPQSKIKDDSFTNTVLVKRESNAAKTDRYPLGSDIQTPSNRRFWKFLKEKGLISDEKYNRLVRTEEFSDEELSGFIARQLVETSQSVKAVASILGELNPETSICYSKAENVSSFRQNFGKIKKGDRDSKNNDQLIKVREINDYHHAKDAYLNVVVGNVYDTKFTRNVFNFIKDKKDGRKYSLNKVFYENVSDSKTVAWEMDKTIHQVEKVMNNNNIMVTRRTSEQKGGLFDATVYKAKVAAKAKDGVYYPLKTSNSVVKDVAKYGGYTSIGIAYYSIFEYTIVNKKGEEKITRIIPIPIYISQNIKDSTALIEFGKSQIFCRAYEKIKDFKLLYRKLCIGSKININNYQYYIGGKSDERFYYDSAIQVTLDKKSEKYLKILSKYQNWKKENKDGELWENITKENNIELYNKLVEKMNSEIFTKKKSNKYNELNSEEIRNNFIKISVEEQAKVLLEILNLLTNKKSIFDLKSIDIKAARGKISFNLTSLIQFSIIEQSITGFYEKEITIIGDKGNDMENNNS

SEQ ID NO: 109 - protein, 702 aa, Helicobacter pullorum
MRKILKIDERIQFKEVDYTAKNPENKKFVEFKNLKKFCEILGAIVGDRALADSIARDMTLIKDEEELAQKLRGYGKFSQEQITQLSALHFSHHISLSLKALSEILPFMREGMRYDEACQEAKLQAKHNDKKSKFLPPFCESIYADELTNPVVHRAIAEYRKILNALIAKYGSVHKIHIELTRDVGKNFQEREKYKKEIESNYKARVQAMQECEKLGLTLSEGNILKLRLFREQNEICVYSGRKITLANLKEQGALEIDHILPYSRSSDDSYMNKVLVFTNENQNKGNKTPYEAFGGDSQKWGEIESLALRSGYPKKKAKRILDKGFGDREAGFKSRNIVDSGYIARLIANYTKEYLKFLPLDSHENTALIAGEKDSKIHVEAVKGMLTATMRHFWGLGSKNRYEHTHHAVDAIIIAYINAAMIQRFSQFRQNQESLKARFYAKELAKEEFKTQRAFFEPFSGFREQVLAKVGQIFVSRPPRKRARGALHEETFYSIDDKKLSETYGGKKGVQRALSLGKIRQIGTKIVANGPMVRVDIFKHTQSGRFYAVPIYTMDFALGILPNKAVVSGKDKDRIIKDWLEMDSCYEFCFSLFKDDVIEVQKRDMEKPELAYFVSLDASDGRIKVRHHCNDITKINENQKKLFSEAIEKEVVGRGSIQNLKVFKKYKVSPLGEIKEAKYEPRQPIALKTSPKKHRKQNNAQ

SEQ ID NO: 110 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKILTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYTKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGMTLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 111 - protein, 1007 aa, Helicobacter canadensis
MKVLGFDIGINSIGWAFVENNELKDCGVRLFTKAENPKTKESLALPRRNARSSRVRLRRRRSRLLSLKHIISKEFGLHYEDYIALDGNLPKAYTGKIESIYKLRYEALSQAISKEDLARVILHIAKHRGYMNKNQKTSQDSEKGAILSAIKENSNKIKHYQTAGEYFYKELFENLRDGTKEFKNIRNKAMKNEKTGNMESTYYNTILASDLEKELKLILEKQQAYHNYSDTFIKEVLEIAFYQRPLKDFSHLVGSCTFYENEKRACKNSYSAWEFIALGKIINTLESIKKDTGEIFSNEIITQILKEVLDKGSLSYTKLRKMINLDEKVKFKGLKYDKEGVEKTNLIEFKKLKEFKKALGEHNLERKTLDEIATHITLTKDENQLKKQLEQYALSQNQIDALAELDFNDHINLSFKALYEILPLMEKGKRYDEACNELGLKAKTSNQKSEFLPAFCDSIFAQELTNPIVNRAISEYRKVLNRLLKKYGKMHKIHIELARDAGLSKEARNKIEKEQKENKDINDKAEKTCKEFGLKPNAKNILKIKLWREQGEICAYSGKKITIDDLKEDKALEVDHIYPYSRSYDDSYNNKVLVFIKENQLKLNQTPYEAFGSNQEKWSKIQVLAQKLPYKKKNRILDENFKNKDQIEFISRNLNDTRYATSLIAKYTKEYLEFLPLSDDEDISLKSGEKGSKTHVQTMNGMLTSVLRHAWGFSQKDRNNHLHHALDAIIIAYSTNSIIKAFSDFKKNQEILKAKLYAKKLTSEEYKNQSKFTGFEKYRSKILEKLDSIFVSKPPNKNTKGALHEQTFYSYQDILEEYKTQEGLKRALECGKVRKIGTKYVVNDRMVRLDIFKKDNKFYGIPIYTMDFALGVLPNKVVTIGTDKDKIKKEWKTIDETYEFCFSLYKGDLVLIQKKEMQESEFAYYNGFDISSASISLEKHDNKFENLTENQKLLFPKAKEGDVEVRGIGIQGLKVFKKYMVTPLGEIQETRTEARQNIQPRKKHGLR

SEQ ID NO: 112 - protein, 1397 aa, gamma proteobacterium
MTKNYISPIAIDLGAKFTGVALYQYLEGADCTQEVAKGLLVDDRGNVTWSQEGRRGKRHQVRGYKRRKMAKRLLWLILDSEYGIKREEVTEPLLKFINGLLNRRGYTYISEEVDEESMNVSPLPFSEMMPDYFNSSAPLLEQLAKLLSDKNKLVRFRAEGKIPSNKNEFKKLLDTALDGKYKDEKKELSEAWGNILIASENVLKSTVDGHKSRSEYLANIKEDIKSNEELEKQISSKEIDGFYNLVGHLSNFQLRLLRKYFNDPNMSGVSYWDEKRLEKYFYQWVQGWHTKGGTDEAEKKNIILKTKGAPLLKTLKSLSADLTIPPYEDQNNRRPPKCQSVLLSDEKLTMHYPKWKEWVGQLVKQNDNAYLNENVTLANALHRIVERSRSIDPYQLRLLISITDAEKRNDLAGYKRLKLSLGSEVDEFLLLVKNIVDETKEAREGLWFETENKLFFKCGKTPPRKEKLKSTLLSAVLGKNLSDDEQSSFIEEFWKSGTPKIERRNVRGWCRLASQVQKTYGVYLKEYGLQQLHKLEAGKKLDDKPLALLYKNSGLIASKIGEALNIEPDEVSRFASPHSLAQIFNIIEGDVAGFNKTCRACTYENIWRMQEEKVESLLTNQLLSEIHGERKVPLKSAMCTRLSADSTRPFDGQMASIIEHIARKIAQHKIAQINDVPKEFSIDIPIIIESNQFSFTAELEEIKRGRGSAKAKKAKELGEKSKAGWVSKTERIKTSSEGICPYTGAPLGGSGEIDHIIPRSLTGRTKKTVFNSEANLIYCSSKGNHDKGNRVYVIEQLNDKYLKKQFSTSDVNLIKKKIKTTIQRFTEGGEKLRSFSELSREDQKAFRHALFVPELKSEVTSLLAVKNITRVNGTQAWLAKKIASLLAEHLDKQGRDYTLSAHQIDPWSVSKQRKMLASAEPIWAKKDPQPAASHVVDAVCTFLEALEQPHTASRLKTISSTSFEKTGWRSALIPDLIKVDALDRRPKYRRYNIGSTSLFKDGIYAERFLPILIDENGLMAGYDIDNSLKAKGADVVFESLSPFLLFKGEEVGAQSLSDWQERIDGRYLYMSIDKVKAFDYLQEKVGEKDIAAELLNSIHFTQRKTELRAKFSDDSGKKMKTLDAIRKSLKLTVTVNEIGKRKEKCGFSGTIGIPAKSAWENLLDEPLLETYWGTKMPPQEIWEKVYRKHFPRNIPNQAHRKVRKDFSLPVVDSVSGGFRVKRKTPNGYNYQLLAIDGYSAVGFKKEGDNVDFKSPALVPQIAESKSVTPISSELVHLDKNEIVYFDEWRKIDISDSDLKQFVSSLELAPGSQNRFYIRFTVDEDQFERHFKSALRVNGIQDLDTVNKTFDWNREIPSLLIPPRSNLFLLETGQKITFEYIANGANAEVKKAYSLRRA

SEQ ID NO: 113 - protein, 1082 aa, Neisseria meningitidis
MAAFKPNPINYILGLDIGIASVGWAMVEIDEEENPIRLIDLGVRVFERAEVPKTGDSLAMVRRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHISGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 114 - protein, 1334 aa, Listeria monocytogenes
MKKPYTIGLDIGTNSVGWAVLTDQYDLVKRKMKISGDSEKKQIKKNFWGVRLFEKGETAAKRRMSRTARRRIERRRNRISYLQEIFAIQMNEVDDNFFNRLKESFYAESDKKYNRHPFFGTVEEEVAYYKDFPTIYHLRKELIDSQKKADLRLVYLALAHIIKYRGHFLIEGALDTKNTSIDEMFKQFLQIYNQVFANDIEEASLKKTEKNQEVAQILAEKFTRKDKLDKILSLYPGEKTTGVFAQFVNIIVGSTGKFKKHFNLHEKKDINCAEDTYDTDLESLLAIIGDEFAEVFVAAKNAYNAVVLSNIITVTDSTTRAKLSASLIERFENHKEDLKKMKRFVRTYLPEKYDEIFDDTEKHGYAGYISGKTKQADFYKYMKATLEKIEGADYFIAKIEEENFLRKQRTFDNGVIPHQLHLEELEAILHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINQIESPTIEGLEDSFNASYATYHDLLKVGMKQEILDNPLNTEMLEDIVKILTVFEDKRMIKEQLQQFSDVLDGTVLKKLERRHYTGWGRLSAKLLVGIRDKQSHLTILDYLMNDDGLNRNLMQLINDSNLSFKSIIEKEQVSTTDKDLQSIVAELAGSPAIKKGILQSLKIVDELVSVMGYPPQTIVVEMARENQTTNKGKNNSKPRYKSLEKAIKEFGSQILKEHPTDNQELKNNRLYLYYLQNGKDMYTGQELDIHNLSNYDIDHIVPQSFITDNSVDNLVLTSSAGNREKGDNVPPLEIVQKRKIFWEKLYQGNLMSKRKFDYLTKAERGGLTEADKARFIHRQLVETRQITKNVANILHQRFNYKTDGNKDTMETVRIVTLKSALVSQFRKQFQFYKVREVNDYHHAHDAYLNGVVANTLLKVYPQLEPEFVYGEYHQFGWFKANKATAKKQFYTNIMLFFAQKDRIIDENGEILWDKRYLETVKKVLGYRQMNIVKKTEIQKGEFSNVTPNPKGKSNKLIPRKKDWDPIKYGGFDGSKMAYAIIIEYEKQKRKVRIEKKLIQINIMEREAFEKDEKTFLEEKGYHQPKVLIKVPKYTLYECKNGRRRMLGSANEAHKGNQMLLPNHLMALLYHAEKYEAIDGESLAYIEVHRALFDELLAYISEFARKYTLSNDRLDEINMLYERNKDGDVKSIAESFVSLKKFNAFGVHQDFSFFGTKIERKRDRKLNELLNSTIIYQSITGLYESRKRLDN

SEQ ID NO: 115 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYIGPLSKGDASTFAWLKRQSEEPIRPWNLQETVDLDQSATAFIERMTNFDTYLSSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQAFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 116 - protein, 1426 aa, Capnocytophaga ochracea
MKNILGLDLGTTSIGFAHIVEDENKEKSEIKELGVRIVSLTTDEQSDFEKGKSITTNANRTLKHGARLNLDRYQQRRKYLIDLLQKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTTENKGSKESVRLQAYQWRAEAISKQLSKEEVAYVLTEINNNLNNASGYLGAISDRSKELYFNRQTVGQYLYAKLQENRHNSLKNKVFYRQDYLDEFERIWETQASFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSAKDDWSLDESPLSASEIREKVKAIFQTLGICTKILYFDPLLPVKEFEEQDSYQLWHLLYSYESDDSTSGNETLYRILEKKYAFKREHARILANVALQDDYGSLSTKAIRKIYPNIKENQYSTACEKAGYKHSKLSLTTEELEARELKNIIPLLKKNALRNPVVEKILNQMINVVNALIEKNSERDAEGKITKYFHFDEIRIELARELKKNAQKRYEMTQNINKAKLEHQKISEILQKEFGIKNPTKSDIIRYRLYQELEHNGYKELYTNAPIARDMLFSKNIEIEHIVPKARVFDDSFSNKTLTFHRINSDKGEYTAFDYITSLNSEEELNQYLTRVENAYKTKSISPTKYKNLLKKASEIGDDFINRDLRDTQYIAKKAKEILFQVTKNVLSTSGSITDRLREDWGLVDVMKELNMPKYQSLGLTEVEERKDGNKVTVIKNWTKRNDHRHHAMDALTVAFTKPSYIQYLNHLNARKDENNKNYSVILAIEEKETIKVPTNNGKNKRVFIEPIPNFRQVAKKHLEEIFISHKAKNKVVTKNTNKPAGTDKQQITLTPRGQLHKETIYGKYQYYINKEEKIGVKFDERTIAKVSNPVYREALLKRLQANDNDPKKAFAGKNALSKNPIYLDESKTKTLPEKVNLTYLEEDFSIRKDISPDNFKDLKSIEKVIDQGVKRILIKRLQAYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFDAVVRAQQGIPIIDKTYKQAEGWQFLFTMKQNEMFVFPNATTGFNPAEIDLLDPKNKKLISPNLFRVQKIATKDYFFRHHLETNVETDNILKNVTWKREGLSGLKDIVKVRINHLGDIVSIGEY

SEQ ID NO: 117 - protein, 1424 aa, Parabacteroides sp.
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYRSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 118 - protein, 1395 aa, Lactobacillus jensenii
MKEIKDYIIGLDIGTNSCGYVVTDKQNNILKLKGKTAIGARLFKEGQAAADRRSFRTTRRRLARRHWRLGLLEEIFDPEMEKIDPNFFRRLKESDYSPKDSRKQFNAIVFKSIKADKRFYKKYPTIYHLRNALMHDNQKHDLREIFMAVHHIVKYRGNFLREDSVNAFKAAKFSLRGEDGIGPVDKLNDLLKEIYSEYSPELATNNLSKIEDIIKDKNLYKQDKLKQVATLLIKEADSKDKAKLNKDIAKQVANSFMGYMFRLDTLFSLTDVDVKDYKLKFSDANIDESLDDLTSLLTDAQIEFVLELQSIYNTIVLNEIVPDGMSLSESMIKKYDDHKEDLKIFKEYIDSLSDQKKAKKLLSAYNLYVNYRKSDLVEAKNLFKNKKVGDKNFADVISNFEVFGKFVSDNLDDSELANKIKARLDLGEFLPKQRTNQNGVIPYQLHQVELTQILEKQGKYYPFLITPNPVESHRNNAPYEISELVSFRVPYYVGPLIDNQSIKDKQNKNKFAWMVRQKQGQITPWNLEEMVDTTESANQFIKRMTRKDTYLLAEDVLPKSSLVYQKFMILDELNRIKIDGKKLTSELKHDIFEKLFKKQKSINLDNLKNYLLVEGNIPGLIEGLSDGINFNNSFSTYIDYRNIFGDEIDNPNKQADFEKMIEWSTVFEDRKIFKRKLKEITWLTSEQIKQVSSKRYSGWGRLSKKLLTQITDENGVNILQRLWNEPETLTEVLANPVIKRKIVEANSSFTKAKDMKDILVEAYTSPQNKKAIRQVMRVVDDIIAAAHGKKPSQIAIEFAREDQDNPQMTKSRKAQLDQIYAKISDEFLDDAVKNELKNMKDNKPLAKDKVFLYFKQMGRDAYSGEKLSLDNLQDYDIDHIYPQSFIKDDSFDNRVLVQRAYNNGKSDNVPVLLFGNKIAAGLGITIRQMWKKWLELGLISKRKFNNLITDPEKISRNMASGFVNRQLVETSQVIKLVANILQAKLPDTEIIEVKASYNSILRKEFNLYKSREVNDYHHAIDAYLTTIVGNYLYQVYPKLRPYFVYGQFKKFGKAENQEDDPVKKIKKFNFIYQLIWGKDDAICISHTNQQVFSKKDIIDKLTTAYNFKYMNISHAVYTRNNNMFKQTLFPIIERTTAKTKSLIPKKLDRPTDIYGGYSNNNDAYLALVKVDKKRGSEYRVVGIPMRAAAMLKASKNYDEDLRKVIEPMVMFDKNGKAKRGIEGFRVLVGKMPFKQAVLDGNKKFMLTGTVDTPNLKQLVLSQQNMKYILDYIEDVDCRKHKFGDKVQNPDKCLLEVFDEIIEIVDKYFELFDSRDFREKLRNSRNKFIKLEASKKADTILAILKGLQAKSTRATIKELNISDFGRIITSSISPEAQLIYQSPTGLFERRVKVKDL

SEQ ID NO: 119 - protein, 1140 aa, Roseburia intestinalis
MRENGSDERRRNMDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRTGCSWSEKGYILTPRNKAENYQHTMLRAMLVEEVKEIFSSQRRLGNEKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTAHKPYGEWKVMEDKDFLFSLYSRDLIHIKSKKDIPIKMVNGGMEGIKETYAYYIGADISAANIQGIAHDSRYKFRGLGIQSLDVLEKCQIDVLGHVSVVRSEKRMGFS

SEQ ID NO: 120 - protein, 992 aa, Treponema vincentii
MQKNSGEDENCGFEFLTEEEKELIKPLFFRISKPSFQFADIEKKLKGKNGFWKFNYRKDTNVSGCPVSAGLKNIFGDEASAESWKDKKVGQYDMCDIWHVLFDFDDEEKLLEFAKRKLFLSDEAAKKFCAIRIQQGYANLSLKAIRKITPFLRKGYIYSTAVFLANIPFMIGRDIFLQNEKEIEDSVKNIIGTLRDKNNIIVLANRCIESAFKDKDNDFRFEEWDKALVENSAWDLFGKKKWNEYDEEKRKTIISQVSEKVEDNLKIAVGKNPNDYKYPLLRTDDLIMDYLNQKGFVVKGELYHPSDTDYNFETPVPAEDGKIYLASPRSPSVKNPVVMRALHQLRKLVNYLIKTGKIDSTTKINVELANDVNDKNQRKAIEELAKTNEKNNADARKKIEELCNEAGFKVVPTESDIKKFRLWKEQNETCPYTGKHISFTDLFGPIPKFDFEHTIPRSLSYDDSLENLTLCDSEFNRNIKKQRLPSELPDFEEINKRFLKFYEDKIDNCLRIIELNSKSGGSYEEPAVKDLRIVKKHKAQYELNYYKEKLRRFSSTEITSGFKHSQLNDTRIITKFSLSYLKGVFDHVQPVKGSMTDTFKRQWGLMERNEIKDRSNHTHHTVDALTVACINRGKFNLLSEAIKNSSDGKHLKFPKPWETFDTDVLNAVRYIIPKYFSDESSLRQSKKILRGRDGKPVLKNGKAVFIQGATARGSLHKDTFYGCIKTVPEKGGKSEMIFVQRIPVSTLDEKVAEKIIDKRIRKTFEKNLSTGIQTLQEIQTDGILLPFKKEGRDVFVKRVRIKAHPTSPIILKKHHNVINKNPKDYKQNYYVENEENYLLAIYRGKDAKGKDVSDHKLCNLLNAVKSRQNKTGFYPDFKEKKGINLQLYKVLKIGKIVILQNDIQEDVFALPKEKLWKRMYRIAGLATSRNDIQIKLVHIIRETPWGYMKGEKDLNAGKECLLYGTANFKGLVEGQDFTVSPAGEIIQKARVC

SEQ ID NO: 121 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVPDEKKQSRHPVFATIKQEKSYHQTYPTIYHLRQALADSSEKADIRLVYLAMAHLLKYRGHFLIEGELNTENSSVTETFRQFLSTYNQQFSEAGDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEAFYKFVKKELTGIRGSEVFLTKIEQENFLRKQRTFDNGVIPHQIHLSELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNDPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 122 - protein, 1363 aa, Lactobacillus rhamnosus
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 123 - protein, 1234 aa, Prevotella tannerae
MPNFWSIFTENLQTYLMKTRILGLDTGTNSLGWAVVDRDENNQYTPICRGDLIFTEGVKQEKGIEFSLAAERTSYRASRRHYFRRRLRKVEVLKVLVKHKLCPPLSDEALNRWHTKKEYPLDEDFILWQRTNEADNKNPYHDRHICLHRKLNLKDSQTDRYTLGRALYHLTQRRGFLSNRLDQNEEAEETGKVKSAISELSKEMKEAGCEFLGDYFYLLYRTEGNRVRIRSRYTDREKHYLQEFKEICRVQELDEDLAKALEKTIFFQRPLKSQRQGVGKCTMEKGHSRCAVSHPLYEEYRLLCYLNNIRIKTPSDDRLRPLNAEEREKITPLFYKEKNFDFEKIAKKLAGKTPFGWIRDAEDWPYQFNYRMTQEAPACPTTAQLIKVFGEDWKAALAETYTMSAKQDGTLKTEDEICTDIWNVLYSFSSKEKLKEFGLKKLQLDEVQAKAFSEIRLTRDFASLSLKAIRKILFFLRTGEDYSKAIFLANIPTIVGEEIWNDIERRSRLLYKVDLALRPQEERDAEEHRTIAERIKAAVAAEVPDAPIDLLYHPSMIEAYPDAKRNERFDCYQLGSPKTNAVRNPMAMRSLHMVRKVINHLLRKHIIDEKTEIHIEYARELNDANKRQAIADWQRELSKRHTAYAQNIRQLYKAETGLVIEPTKADILKYQLWEEQQHVCLYTGKKIGIADFLGANPKFDIEHTIPRSRGGDSTQENLTLCESKFNRDIKRDKLPTELANYEEILARIEHWKKQCYALKLKRDGIRTHSGLEKSIKDSRIRRRHLVGLEYGYLKGKYDRFTMKEVPEGFSRRQGAGIGLISKYAGLFLKSLFKDPKNPNRSNVYVVKGAITAEFRKLWGLQQADEAKSRENHTHHCIDAYTIACIGPCEYAALAAYYRSDEEFKYGRRREKPQFEKPWPTFTEDLLKLQEELLIVHQTTDKLGKRDRRKVKTPRGKFLTGGDSARGRLHQETYYGAINYDGNIKYVVRKPLDSLTEKDLDKIVDETVMGIVKGAVEAKGSLKEALADGIYMNKEKGILIKRVRIFSDVSEPINLKQLRDVSTKEYKRHIHLRKDENYLFAIYEGIDKKKNKKQTETATVDYLDAAKFYKDSKRRDKANSLVGDYSKKNKLPLKCILKKRQMVLFYEHSPEEIRFKDKKDLSRRLYIVTSIAKDGRVKFLHHQAATATGIQSSPSPFTNDGEHQPYYRLSASNIKVLVAGIDFDINILGEITPKL

SEQ ID NO: 124 - protein, 1496 aa, Prevotella veroralis
MKTILGLDLGTNSIGWAKVCVDDNGNYLRDIKLGSRIIPMSQDVLGNFDKGVTESQTSVRTGFRGVRRIRERSLLRRERLHRVLHVLGYLPPHYDSAIGWNKNEPSTYGKFLNHGEPKLAWEHKEDGSMRFLFMESFHEMMADFAKSQPSLVSDGKKIPLDWTIYYLRKKALSQPIRKEELAWLLLNFNQKRGYYQLRGEEDDDNPTKCEEYYELKVVGIEADEEGKNGNTWYNVKLENGWIYRRQSKIPLDDWIGKVREFIVTTEYEKDGITLKKDKNGDVKRSFRSPSEDDWGLRKKRTEKLLDSSKMTVGAFVYDHLLAEPSDKIRGKFIRTIERKYYKKELYAILCEQSKYHEELRSGDYLNKCAEELYKNNQPHRNSLLTKDLAYLLLEDLIFYQRPLKTKKSLIAECPYEAYKYVDKETGEIKRQGIKCIAKSNPYYQEFRLWQFISNLRLFNKADDKEVTADYLPTQDDYVRLFAYLNDRKEINQETLLKEFFKLKKITVNSEKVFPIRWNYIEDKEKKYPCNETRHELLLALDRARIDHSWLEKPGQEYRLWHLLYSVESKEETKEALRKLKDDDAFVESFLKVKPFKREYGAYSEKAIKKLLAVMRMGSLWRETDICDTTKGNITKILQGEIDEKLKEKISASVSSYNQLSDFQGLPVWLACYVVYGRHSEAAEIQHWKTPESLLAYINGFKQHSLRNPIVEQCILETLRTVHDIWKEVGHIDEIHVELGRNMKSTADQRARISENVLRNENTNLRIKSLLLELKNDPNIKDVRPYSPMQQEKLRIYEEGVLQELTKDDKDFTEITKISTMAQPSAKELQRYKLWLEQKYRSPYTGKSISLTKLFTSAYQIEHVIPQSRYFDDSFSNKVICESEVNSLKDNMLGYEFIKNHGGEIIHCTMLGDVKVLSESEYKAFVNDHYAHNKRKRENLLLEDIPQEFLNRQMNDSRYISKVVKALLSNIVRAEGEEEATSKFVVSCSGGITDRLKKDWGLNDVWNKIVYPRFERLNRLTGTEAFGQWENKDGKRVFQTAVPLELQRGFNKKRIDHRHHAMDALVIACTSRNIINYLNNESANNPKKREDLRQKLCDKNRTIRKPWETFTQDATAALEDVIVSFKNYVRIINKATNYYERYDVEGKKVIAEQRGDDMWAIRKPMHEATYYGRVNLRRKKKVNLRVALENISSICDNKLRIYINGLVEKGFNTKQILDKFKNTNDHFSMQKIDKVEIWQFTNEEEKLVATRKPLDTSFDTKKIASITDTGIQTILLNYLETKGGDSTIAFTPEGIVEMNQNISKYNNGKEHMPILKVRLYTKLGKKIPVGQTGCKAKQFVIAEAGTNLYFAIYEDEEGKRSYRTIPLNEVVERLKQGLSPVPEKNDKDVHLKFYLSPNDLVYVPIEDEHESLAKDHIYKFVDSSGTTANFIPHRSANVIFELNKKDAEKFCSGSIIQNEYGVGSSQSKNQKAITGEMIKAVCRKLEVDRLGNVIKVI

SEQ ID NO: 125 - protein, 1082 aa, Neisseria cinerea
MAAFKPNPMNYILGLDIGIASVGWAIVEIDEEENPIRLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNTHALQTGDFRTPAELALNKFEKESGHIRNQRGDYSHTFNRKDLQAELNLLFEKQKEFGNPHVSDGLKEGIETLLMTQRPALSGDAVQKMLGHCTFEPTEPKAAKNTYTAERFVWLTKLNNLRILEQGSERPLTDTERATLMDEPYRKSKLTYAQARKLLDLDDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGNRYDEACTEIYGDHYGKKNTEEKIYLPPIPADEIRNPVVLRALSQARKVINGVVRRYGSPARIHIETAREVGKSFKDRKEIEKRQEENRKDREKSAAKFREYFPNFVGEPKSKDILKLRLYEQQHGKCLYSGKEINLGRLNEKGYVEIDHALPFSRTWDDSFNNKVLALGSENQNKGNQTPYEYFNGKDNSREWQEFKARVETSRFPRSKKQRILLQKFDEDGFKERNLNDTRYINRFLCQFVADHMLLTGKGKRRVFASNGQITNLLRGFWGLRKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHKYVTPLFISRAPNRKMSGQGHMETVKSAKRLDEGISVLRVPLTQLKLKDLEKMVNREREPKLYEALKARLEAHKDDPAKAFAEPFYKYDKAGNRTQQVKAVRVEQVQKTGVWVHNHNGIADNATIVRVDVFEKGGKYYLVPIYSWQVAKGILPDRAVVQGKDEEDWTVMDDSFEFKFVLYANDLIKLTAKKNEFLGYFVSLNRATGAIDIRTHDTDSTKGKNGIFQSVGVKTALSFQKYQIDELGKEIRPCRLKKRPPVR

SEQ ID NO: 126 - protein, 1512 aa, Fibrobacter succinogenes
MKKILGLDLGTNSIGWAVVNADEITRDDGSRYLKPNGISAAGSRIIPMSADILGDFEKGNSISQTAERTRMRMARRLHERALLRRERLLRVLNLLDFLPKHFADKIDRYGKFTDDSEPKLAWRKNTEGKYEFIFQDAFNEMLAEFKDKQPEIVEEGKKIPYDWTIYYLRKKALEKALSKEELSWILLQFNQKRGYYQLRGEEEEIPQDKKIEYLAQKVVKVEATDQKKGDDVWYNVYLENGMIYRRTSKAPLDWEGKVKEFIVTTEVENDGETPKKDKEGNIKRSFRAPKEDDWTLLKKKTEADIENSHKTVGCYIYDSLLNNPKQKIIGKLVRTVERKFYKEELTQILKKQVELIPELRDDNLYKQCIEELYPINEAHRNTIAKTDFANLFINDILFYQRPLKSKKSQIDNCPYEERIFIDSKTGEKKKVPVKCIAKSNPLFQEFRLWQFIQNLRIYQREKEIDGKLLTDIDITSECLKSEEDYVRLFDWLNDRETIEQEDLLKHLFNTKKSKNKENPYRWNYVEDKVYPCNETRATILKGFSKCGINASVLSPELEMALWHILYSVEDKKEIETALTHFAQKQGWNDDFAKVFSKAKPFKKDYGSYSEKAIKKLLSLMRMGKYWNQDNIDKNTLDRIDKIINGEYDEKISNRVRDNAINLKDISDFRGLPVWLACYIVYDRHSEAKDCTKWNSPEEIDSYLKKFKQHSLRNPIVEQVVTETLRTVRDIWIQEEQIDEIHLELGRDLKNPADKRKKMSENILKNENTNLRIKAMLMEFMNPSMGIENVRPYSPSQQDILRIYEENALDNLTKDDKDFDFISKISKQAQPSKTDIIRYKCWLEQKYRSPYTGKTISLSKLFTPAYEIEHVIPQSLYFDDSFSNKVICEAEVNKLKDRQLGYKFIAEHHGEKVQLSQGEVVEILSVDAYEKFVKENYANNRIKMKKLLMESIPDEFIERQLNDSRYISKVVKGLLSNIVREKIDDENYEPEAVSKNLISCNGAITDRLKKDWGMNDVWNSIILPRFIRMNQITGKDCFTTTNAEGHLIPQMPLELQKGFNKKRIDHRHHAMDAIVIACTTRDHVNLLNNEAAHSKFNATRYQLQRKLRRFEKAVIDGKEREVAKEFLKPWDSFSSDSKNILENIIVSFKQNQRVINKTTNAFLHFDENGKKTFIKQGKGDSWAIRKSMHKDTVFGEINLRKVRSVSLNEAIKVPERVLNKKIKEKILELKNNKIDAKNIKKYIEENHTGGYGIDSSKIDVFYFTKETKERFFATRKTLDTSFNQAKIKDSIADSGIQKILLAHLKSKNGDAEQAFSPDGIDEMNKNIVELNNGKFHQPILKVRVYEKADKFAVGQKGNKKVKFVEAAKGTNLFFAIFEKDGKRSYLTIPLNVMIDCQKQYGNQWKNNIEAYLKEKELVEKDVKLQFILSPNDLVYLPTEGSIDKKRIYKVVSFTNNRLYAIPYAIAKSIVDKNEFTQLNKIEFTDNKESIKDACVPVIIDRLGNVIEFNGKRL

SEQ ID NO: 127 - protein, 1259 aa, Streptobacillus moniliformis
MKYILGLDLGVASIGWAVTEINEKGEPVGLIDANSVIFKPLDNDKGKLYNVERRDKRGSRRILRRKKHRVERTKMLLVNSSFLTNEEIDNLYVGKLDNIYEVRLKGLKEQLSKNEIARLMIYYCKNRGFKSNRKTEDLEILKSLGEKISEKDSDEKKLKPIIAKNTELIESKGLTPIEVIYMIRENDNSILGFKNKEGNYKFGFKRNQVIDEVRKILGTQQILSKEIVDEYIDILSSQRDFSDGPGGDSKYKIDYTKLAGKCKYTGEVRAVKSAPSYEIFTMLQKLNDIRYVKFTSEDKIEKKKLSKEVIHKLYDLVVEKNKTLTYDLIEKSIDEENIKLLNIPKLSKSKYVELRKSYFKERNDNENLTEEEINAFNEKLNNERMKQELIRNNLKAYKELKSKFKKNNIDENRIKELGGIYFLDLVAELLTYSKTDEKLEYFVENVERYSLFKEQRDIVEIIKTFPNYTKNGNLSLSLVRELNKLLMEGHDYESSLSSLNYYIDTDVDWEKFPTISEIEDSLSTKITNPNVKHILVILRKLYNTLLFKYGRPEKVHLELSRDFSNDFSTRNKIQKEQLENKVRREVAAFEMYGANKDIVAGKDRLSNDDFVRIKLWEEQNKVCMYSGRTIEKYQLTSAEVQIDHILPYSKSFDNSYSNKVLVFSNENQDKKERTPYQWLKGTEKWNEFKQRVRLNLNISNKKKENLLFEDEVVNNEFLERELHATSYSSRLALNIFQRLIPVSDEDKYDEHGNEKVKYLYNRNVIAFQGKMTSMLRNLYSLNKYTHSFESDTLDIDNKAFILKEFEINKDNLKMTAYNVNTGLEITSETKVEKNKSGEFKTIKDELLKKELDKKENLIEISDYFKDKVLFDLKIVDFEEIDTVEPEIISILYKMITALKEEVYSKNRENHLHHSLDAFLLTIMNRSMQMKLIKYNQLISVLKNKEIEIFNEEKGEYIDSKEFAEELQKQKIIDIDGNERGIKFNVNGKTHRLNLVKPYENFLDDIKNKIFDKRENNKLPYHVVKSKVSGALHAETILGESKGEITKRISVFDINYKNLGKIFDKDGSQKEIYETLVKWLEAKSKDYPKLKNGNIIKKVKIVDGNKDKLIKLGNKRYVEMGRTTVKILVLKKEAEEGLKFASIGRYKYNLLKSEKDVNISIWKDAIHFCKVRYNKLKENGYRLIHELIPGETIELELNKGNISKCLVVGFSGGKIEISSVIGDALDLINDKISTRIKERYYITVSTIKSIKKINKNILGD

SEQ ID NO: 128 - protein, 1091 aa, Mobiluncus mulieris
MDSRKYRVGIDVGTNSVGFAAVEEDDSGSPTRFLNTMVVIHDSGVDPEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 129 - protein, 872 aa, Candidatus Parvarchaeum
MLGSSRYLRYNLTSFEGKEPFLIMGYYKEYNKELSSKAQKEFNDQISEFNSYYKLGIDLGDKTGIAIVKGNKIILAKTLIDLHSQKLDKRREARRNRRTRLSRKKRLARLRSWVMRQKVGNQRLPDPYKIMHDNKYWSIYNKSNSANKKNWIDLLIHSNSLSADDFVRGLTIIFRKRGYLAFKYLSRLSDKEFEKYIDNLKPPISKYEYDEDLEELSSRVENGEIEEKKFEGLKNKLDKIDKESKDFQVKQREEVKKELEDLVDLFAKSVDNKIDKARWKRELNNLLDKKVRKIRFDNRFILKCKIKGCNKNTPKKEKVRDFELKMVLNNARSDYQISDEDLNSFRNEVINIFQKKENLKKGELKGVTIEDLRKQLNKTFNKAKIKKGIREQIRSIVFEKISGRSKFCKEHLKEFSEKPAPSDRINYGVNSAREQHDFRVLNFIDKKIFKDKLIDPSKLRYITIESPEPETEKLEKGQISEKSFETLKEKLAKETGGIDIYTGEKLKKDFEIEHIFPRARMGPSIRENEVASNLETNKEKADRTPWEWFGQDEKRWSEFEKRVTSLYSKKKISERKREILLNKSNEYPGLNPTELSRIPSTLSDFVESIRKMFVKYGYEEPQTLVQKGKPIIQVVRGRDTQALRWRWHALDSNIIPEKDRKSSFNHAEDAVIAACMPPYYLRQKIFREEAKIKRKVSNKEKEVTRPDMPTKKIAPNWSEFMKTRNEPVIEVIGKVKPSWKNSIMDQTFYKYLLKPFKDNLIKIPNVKNTYKWIGVNGQTDSLSLPSKVLSISNKKVDSSTVLLVHDKKGGKRNWVPKSIGGLLVYITPKDGPKRIVQVKPATQGLLIYRNEDGRVDAVREFINPVIEMYNNG

SEQ ID NO: 130 - protein, 1229 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDIREIYLAVHHIIKYRGNFLNGTPMRSFKVENIELNTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKGIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRHLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIEREKKVVAPETGEILWSNVAPNETIKQIKKVYNYKFMIVSREITTRRAELFNQTVYPKNYRGKLIPIKEDRPTDLYGGYSGNTDAYLAIVALEDKKKGKYFKVVGIPTRAAAKLEKLKQQDSQQYLQALHEVIAPQFTKSTKKGIKKTEFEIVLDKVHYRQLVQDGPVKMMLGSSTYKYNAKQLVLSEKAL

SEQ ID NO: 131 - protein, 1398 aa, Veillonella parvula
METQASNQLISSHLKGYPIKDYFVGLDIGTSSVGWAVTNKAYELLKFRSHKMWGSRLFDEGESAVARRGFRSMRRRLERRKLRLKLLEELFADAMAQVDPTFFMRLRESKYHYEDKTTGHSSKHILFIDKNYNDQDYFKEYPTVYHLRSELMKSGTDDIRKLFLAVHHILKYRGNFLYEGATFDSNASTLDDVIKQALENITFNCFDCNSAISSIGQILMEAGKTKSDKAKAIEHLVDTYIATDTVDTSSKTQKDQVKEDKKRLKAFANLVLGLNASLIDLFGSVEELEEDLKKLQITGDTYDDKRDELAKAWSDEIYIIDDCKSVYDAIILLSIKEPGLTISESKVKAFNKHKDDLAILKSLLKSDRSIYNTMFKVDEKGLHNYVHYIKQGRTEETSCNREDFYKYTKKIVEGLSDSKDKEYILSQIELQILLPLQRIKDNGVIPYQLHLEELKAILAKCGPKFPFLNEVADGFSVAEKLIKMLEFRIPYYVGPLNTHHNVDNGGFAWAVRKASGRVTPWNFDDKIDREKSAAAFIKNLTNKCTYLLGEDVLPKSSLLYSEFMLLNELNNVRIDGKPLEKVVKEHLIEAVFKQDHKKMTKNRIEQFLKDNGYISETHKHEITGLDGEIKNDLASYRDMVRILGDGFDRSMAEEIITDITIFGESKKMLRETLRKKFASCLDDEAIKKLTKLRYRDWGRLSQKLLNGIEGCDKAGDGTPETIIILMRNFSYNLMELLGDKFSFMERIQEINAKLTEGQIVNPHDIIDDLALSPAVKRAVWQALRIVDEVAHIKKALPARIFVEVTRSNKNEKKKKDSRQKRLSDLYAAIKKDDVLLNGLNNEIFGELKSSLAKYDDAALRSKKLYLYYTQMGRCAYTGEIIELSLLNTDNYDIDHIYPRSLTKDDSFDNLVLCKRTANAQKSDAYPISEEIQKTQKPFWTFLKQQGLISERKYERLTRITPLTADDLSGFIARQLVETNQSVKAATTLLRRLYPGVDVVFVKAENVTDFRHDNNFIKVRSLNHHHHAKDAYLNIVVGNVYHERFTRNFRAFFKKNGANRTYNLAKMFNYDVNCTNAKDGKAWDVKTSMDTVKKMMDSNDVRVTKRLLEQTGALADATIYKATVAGKAKDGAYIGMKTKSSVFADVSKYGGMTKIKNAYSIIVQYTGKKGEVIKEIVPLPIYLTNRNTTDQDLINYVASIIPQAKDISIIYGKLCINQLVKVNGFYYYLGGKTNSKFCIDNAIQVIVSNEWIPYLKVLEKFNNMRKDNKDLKANVVSTRALDNKHTIEVRIVEEKNIEFFDYLVSKLKMPIYQKMKGNKAAELSEKGYGLFKKMSLEEQSIHLIELLNLLTNQKTTFEVKPLGITASRSTVGSKISNQDEFKVINESITGLYSNEVTIV

SEQ ID NO: 132 - protein, 1485 aa, Prevotella bivia
MKNILGLDLGTNSIGWAKISIDDNGKYIKDSIKLGSRIIPMSQDVLSNFSKGVTLSQTSERTSFRGARRLRERTLLRRERLHRILHLLGFLPKHYEKAIGWDRNDNKTYGKFINHAEPKLAWCKDNNGKMRFLFMDSFHDMLSEFSEKHPELLANGKKIPLDWTIYYLRKKALYKAITKEELAWILLNFNQKRGYYQLRGEEDRDSEANKKEYLELKVIGVEATGEKKGNDIWYNIHLENGWIYRRSSKNPLNDWLGKVKSFIVTTDLDADGNPKKDKDGNIKRSFRAPSEGDWTLIKKRTESLLENSGQTVGQFIYNHILEEPSAKIRGNFIRTIERKYYKDELKAILEKQKEFHHELSSESLLTECAKELYKRNIAHQEVLLKKGIIHLLLNDILFYQRPLKIKKSLIDNCPYENYKYVDKKSGDIKVKSIKCIAKSNPFFQEFRLWQFVSNLRLYRKSDDKDVTSEHLVTTDDYANLFTYLNNRKDIKQSVLLKEYFKIKKVKTINGAEYPVRWNYIDDDNKTYPCNETRYDILHALSKTELKSEWLTPERTYRLWHLLYSIESKEETKKALNKLNLSDDFTEAFLTIKPFKKEYGSYSEKAIKKLLSLMRMGYLWSEDEAIKQVGAEIEKTIEGELPDYVLQRLEKSQHNYNKISDFSGLPLWLASYIIYGRHSEAKEIIHWDNPESMMAYIKDFRQHSMRNPIVEQCVLETLRTVHDIWKEIGHIDEIHIELGREMKSTSEQRKAITQNVLHNQNTNIRIKLLLQELKNDNNITGVRPYSPMQQEILRIYEEGALQGLTKEDKDYNDILKISQTAQPTSNELTRYKLWLEQKYRSPYTGKAISLSKLFTSAYQIEHVIPQSRYFDDSLSNKVICESEVNTLKKAMLGMEFIKTCGGQKVHCTLLGDVEIYNEEDYKAFVNEHYSNNRTKRNKLLMEDIPQEFINRQLNDSRYISKMVKQLLSAIVRGQEEVEATSKFVIPCTGGITDRLKKDWGLNDIWNNLVSPRFQRMNALTGSEYFGHWENKEGKRVFQTTMPIQLQQGFSKKRIDHRHHAMDALVIACASRNIISYLNNETAQDTERRRDLRQKLCDKGGSVRKPWDSFTQDTQYALKDIIVTFKNYVRIINKATNYYEHYKTDGKKGMISQKGDELWAIRKPMHKETVFGKVNLRRPKRVSLSKAIDSVDIICNRKLKKYIKARLNEGLQKKQILNIFKELNNVWEGIDVNKIDIWEMSNDKEPMVATRKQLDTSFDEKKIRSISDTGIQKILLNYLITKNNNPELAFTPEGIQEMNSNISEYNDHKKHQPIYKVRVTEPLGAKYPIGTMGNNPKKFVEAQAGTNLYFAIYEDKEGKRNYDTIPLNIAAERLNQQLSPVPETNENNTPLKFYLSPNDLVYVPSEEERHSGNNIQLDKNRIYKMVSSTSKRCFFIHHRVAISLVDKKEFSAQNKMERSIDNEQVMIKSVCWKLITDRLGNIIKVIK

SEQ ID NO: 133 - protein, 1218 aa, Prevotella buccalis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYHEQGNKVRIRQRYTDRKKHYQHEFDAICEKQELSSELIEDLQRAIFFQLPLKSQRHGVGRCTFERGKPRCADSHPDYEEFRMLCFVNNIQVKGPHDLELRPLTYEEREKIEHLFFRKSKPNFDFEDIAKELAGKKNYAWIHDKEERAYKFNYRMTQGVPGCPTTAQLKSIFGDDWKTGIAETYTLIQKKNGSKSLQEMVDDVWNVLYSFSSVEKLKEFAHHKLQLDEENAEKFAKIKLSHSFAALSLKAIRKFLPFLRKGMYYTHASFFANIPTIVGKEIWNNEQSRKYIMENVGELVFNYQPKHRDVQGTIEMLIKDFLANNFELPAGATDKLYHPSMIETYPHALRNEFGILQLGSPRTNAIRNPMAMRSLHVLRRVVNQLLKESIIDENTEVHVEYARELNDANKRRAIADRQKEQDKQHKKYGDEIRKLYKEETGKDIEPTQTDVLKFQLWEEQNHYCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYHMEETFRQGRGSKPKFSKPWATFTEDVLNIYKNLLVVHDTPNNMPKHTKKYVQTSKGKVLAQGDTARGSLHLDTYYGAIERDGEIRYVVRRPLSSFTNPKELENIVDETVKRTIKEAIADKNFKQAIAEPIYMNEDKGILIKKVRCFANSVKQPINIRQHRDLSKKEYKQQYHVMNENNYLLAIYEGLVKNKVVREFEIVSYIEAAKYYKRSQDRNIFSSIVPTHSTKYGLPLKTKLLMGQQVLMFEENPDEIQVDNTKDLVKRLYKVVGIEKDGRIKFKHHQEARKEGLTIYSTPYKNNDDYVPIFRQSIKNINILVDGIDFNIDILGKVTLKE

SEQ ID NO: 134 - protein, 1218 aa, Prevotella timonensis
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 135 - protein, 1487 aa, Prevotella timonensis
MKNILGLDLGSNSVGWALVKVEENGNPIGSIKMGSRIIPMSQDILGSFEKGDTVSQTAQRTLYRGKRRLIERHVLRRERLCRVLHIMNFLPAHFDRLLGWDKTDNKTYGKFIDDSEPKLAWRQNKNEMGKMEFVFMDSFHEMLSDFAKHQPQLIANGKKVPLDWTIYYLRKKALTQLISKEELAWILLNFNKKRGYYQLRGEEEEEQPTKKEEYKVLKVISVDADEGQKGNGIWYNIHLEDGGIYKKKSDIPLYDWVGKTLQLIVVTTYEKDGKTPKIFDSGKQNPSYRLPKEDDWGLVKKRTESQLQSSGKTVGAFIYDNILSKPDDKIRGNLVRTIERKYYKKELIEILQQQAKYHDELHNQNLLESCAKELYAHNDVHYNEVIKSNMINLLVNDIIFYQRPLKSKKSLIANCKYESYEYVDKETGEIKEMPIKCIAKSNPYYQEFRLWQFIHNLRLSDVVTREDVTAQYLSTPQDYCNLFTYLNDRKEIKQDILLKDFFKIKKVQIDKEKVFPIEWNYIKDATKSYPCNETRYELLSALKRAGMDKQWLDDTPNMQYRLWHLLYSVEEKEESAKALRKLYDDDKFVTSFLKIKPFNKCYGAYSEKAIKRLLTLMRMGKAWNEQAIDAKTLKCIQQIITDNVDSKLKEKIDDSRYVLHHVSDFQGLPTYLASYVIYGRHSEVTDIQCWDSPEDLLKFIRDFKQHSLRNPIVEQVILETLRVVYDIWKAEKHIDEIHVEVAREMKLTAQQRNEANLRNLNNEATNLRIKYLLEELKNDTFIKDVRPLSPIHQEKMRIYEQAVLGNLNKQDKDYDDIIKISKKEHPTNAELIRYKLWLEQRYCSPYTGKAISLSKLFTTAYEIEHIIPQSRYFDNSFNNKVICEAEVNKAKGNMLGYEFIKKQGGQKIYCTQLGKAVTILKEEAYKQFVNEHYAHNKRKRDNLLAENIPESFSSRQLNDTRYITKTIMSLLSNVVRQQSEEEATAKNLLPSSGSVTDRLKNDWGLKDVWNTIVTPRFERLNKLSGTNDFGEMKEENGNRYFQTNVPLEYEKGFKKKRIDHRHHAMDALVIACTTRNMVNYISNANANSPKQREDLRQLLCDKNRIINKPWDTFTQDALKALNDIVVSFKNNVRIINRATNRYQRYDKNGKKIIFSQKGDDMWAIRKSMHKETVFGRVNLIRKEVLPIAKALDNISAICNAQLRAYVNDLVDKHFNKKQLVAHFKSLNYKWNRQDVSKVEVWISSDNKTPMVAVRKPLDTSFDKKKIASITDTGIQTILLNYLESKGGDASVAFAPEGIQEMNSNIELYNNGKAHKPIKNVRLSEPLGAKYQVGERGAKTKKYVEADKGTNLFFAIYEDEEGKRYYYSVPLREAIERQKQKLSPVPEYNEKGVALKFYLSPNDLVYVPTEEERTMGTCHIDKARIYKMVSSTGCSCYFVPSTFAKVIVDKVELQSLNKMEKAITDECIKEVCWKLKVDRLGNIINVIK

SEQ ID NO: 136 - protein, 1138 aa, Bifidobacterium dentium
MLCRCHRRYRIGIDVGLMSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 137 - protein, 587 aa, Neisseria subflava
MATSRSRIRSQTDAFGVVGSLVAFNQTSRLFVAKKNEGETADKELGALLKGVADNAHALQTGNFRTPAELALNKFEKESGHIRNQRGDYSHTFNRKDLQAELNLLFEKQKEFGNPHVSDGLKEGIETLLMAQRPALSGDAVQKMLGYCTFEPTEPKAAKNTYTAGRFIWLTKLNNLRILEQGSERPLTTTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYIEIDHALPFSRTWDDSFNNKVLVLGSENQNKGNQTPYEYFNGKDNSREWQEFKARVETSRFPRSKKQRILLQKFDEDGIYRIGVKTALSFPKYQIDELGKEIRPCRLKKRPPVR

SEQ ID NO: 138 - protein, 1269 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 139 - protein, 1354 aa, Prevotella melaninogenica
MADFAKYQPGMVADGRKIPLDWTLYYLRKKALTQAIRKEELAWILLNFNQKRGYYQLRGEEEEENSTKHEEYYELKVVSVEAAEEGKGGNTWYNVTLENGWIYRRQSKIELNDWVGKVRPFIVTTEYEIDGVTIKKDKNGEVKRSFRAPSENDWGLRKKRTESLLEESGKTVGAFIYNHILSEPADKIRGNFIRTIERKFYKKELEAILREQSKHQKELKDIDTLIACIKELYPNNKPHQDSLIKKDMTYLLITDLIFYQRPLKSKKSLIADCPYEYYEYVIKETGENKRQSIKCIAKSNPYYQEFRLWQFIINLRLFDRNNDKEVTSEYLSSMEDYTRLFTYLNDRKDINQETLLKDFFKQKKVKRGMEKEFPIRWNYIEDKEKKYPCNETRHELLTALGKVGIDHSWLDDKELFYRLWHLLYSVESKEEAEGALRKLVDNDDFVNAFLKIKPFKKEYGAYSEKAIKKLLAVMRMGNLWNEVDICEQTRDRIQNIIKGDIDEKIKDRMGRTFSQLSDFQGLPEWLACYVVYGQHSEATDIQRWTKPENLMAYINGFKQHSLRNPIVEQCILETLRTVHDIWKEAGHIDEIHIELGRGMKSTADQRARMSKSIMQNENTNLRIKSLLMELKNAKEFENVRPYSPMQQEILRIYEEGALQELTKEDAQYNEISKISQMAQPSANELLKYRLWLEQKYCSPYTGKPISLSKLFTSAYQIEHIIPQSRYFDDSFTNKVICEAEVNQLKSNMLGYEFIKKHGGEIVRCTMIGDVKLLDAKEYYNFVTEHYTNNRRKKEKLLMEDIPQEFLNRQMNDSRYISKKVMAILSNIVREEDEQEAKSKFVIACSGGITDRLKQDWGLNDVWNSIVYPRFERLNKLTNTENFGRWENKKGKQVFQTSVPLELQKDFSKKRIDHRHHAMDALVIACASNNIINYLNNESAKSQEKREDLRKKLCDKNRIIRKPWETFTQDAHTALENVVVSFKNYIRVINKATNYYEKYDKNGKKEIAEQKGQDMWAIRKPMHKETVFGQVNLRRKITIKLKDALEKIPAICDKELRDYINILVAKQFNKKQILAHFKSINYRLNMKSVDKVDVWQFSNEKEPMVATRKSVDTSFDTKRIATITDTGIQKILLNYLKAKNNDPNIAFTPEGIAEMNKHITEYNNGKQHQPILKVRVSEPKGAKYQVGETGNKRSKFVEAQKGTNLYFAIYEDKEGNRSYNTIPLNEVIERLKQGLSPVPDANEKSIPLKFHLSPNDLVYVPKTDEENEIKMGQIYKFVDSSGTTANFVPHRVSNLIYNVDKKIAENFCNHEIIQNEYGIGSPQSKNQKSITGEMIKAVCWKLEVDRLGNIHKIIK

SEQ ID NO: 140 - protein, 1130 aa, Streptococcus gallolyticus
MTNGKILGLDIGIASVGVGIIEAKTGKVVHANSRLFSAANAENNAERRGFRGSRRLNRRKKHRVKRVRDLFEKYEIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCSFYPDEYRASKASYTAQEYNFLNDLNNLKVPTETGKLSTEQKEALVEFAKSTATLGPAKLLKEIAKILDCKVDEIKGYREDDKGKPDLHTFEPYRKLKFNLDSVNIDDLSREVLDKLADILTLNTEREGIEDAIRHNLPNQFTEGQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNGTDKLPDEVFHGNKQLETKIRLWYQQGERCLYSGKPIPIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKISVIRGQFTSQLRRKWKIDKSRETYHHHAVDALIIAASSQLKLWEKQDNPMFVDYGNNQVVDKQTGEILSVSDDEYKELVFQPPYQGFVNMISSKGFEDEILFSYQVDSKYNRKVSDATIYSTRKAKIGKDKKEETYVLGKIKDIYSQNGFDTFIKKYNKDKTQFLMYQKDPLTWENVIEVILRDYPTTKKSEDGKNDVKCNPFEEYRRENGLVCKYSKKGKGTPIKSLKYYDKKLGNCIDITPEGSKNEVVLQSLNPWRADVYFNPETLKYELLGLKYSDLSFEKGTGKYHISQEKYDVIKEKEGIGKKSEFKFTLYRNDLILIKDTASGEQEIYRFLSRTMPNVKHYAELKPYDKEKFDNVQELVEALGEADKVGRCIKGLNKSNLSIYKVRTDVLGNKYFVKKEGDKPKLDFKNNKK

SEQ ID NO: 141 - protein, 1371 aa, Streptococcus gallolyticus
MTEKNYSIGLDIGTNSVGWAVITDDYKVPAKKMKVLGNTDKKYIKKNLLGALLFDNGETAEATRLKRTARRRYTRRKNRLRYLQEIFAEEMAKVDESFFYRLDESFLTTDDKDFERHPIFGNKADEIKYHQEFPTIYHLRKHLADSHEKADLRLIYLALAHMIKFRGHFLIEGELNAENTDVQKLFEAFVEVYDRTFDDSNLSEITVDASSILTEKFSKSRRLENLIKHYPTEKKNTLFGNLVALALGLQPNFKTSFKLSEDAKLQFSKDTYEEDLEELIGKIGDEYADLFTSAKNLYDAILLSGILTVADNTTKAPLSASMIKRYNEHQVDLKKLKEFIKNNASDKYDEIFNDKDKNGYAGYIENGVKQDEFYKYLKTTLSKIDGSDYFLDKIEREDFLRKQRTFDNGSIPHQIHLQEMHAILRRQGEHYAFLKENQAKIEKILTFRIPYYVGPLARKNSRFAWAEYHSDEKITPWNFDEIIDKEKSAEKFITRMTLNDLYLPEEKVLPKHSLVYETYTVYNELTKVKYVNEQGKSNFFDANMKQEIFEHVFKENRKVTKDKFLNYLNKEFPEYRIQDLIGLDKENKSFNASLGTYHDLKKILDKSFLDDKTNETIIEDIIQTLTLFEDRDMIRQRLQKYSDIFTPQQLKKLERRHYTGWGRLSYKLINGIRNKENGKSILDYLIDDGYANRNFMQLISDDTLPFKQIIKDAQIIGDIDDVTSVVRELPGSPAIKKGILQSVKIVDELVKVMGHNPDNIVIEMARENQTTNRGRNQSQQRLKKLQDSLKELGSNILNEEKPSYIEGKVENNHLQDDRLFLYYIQNGKDMYTGDELDIDHLSDYDIDHIIPQAFIKDDSIDNRVLTSSAKNRGKSDDVPSLDIVHDRKADWIRLYKSGLISKRKFDNLTKAERGGLTENDKAGFIKRQLVETRQITKHVAQILDSRFNTERDENDKVIRNVKVITLKSNLVSQFRKDFKFYKVREINDYHHAHDAYLNAVVGTALLKKYPKLAPEFVYGEYKKYDIRKFITSSGDKATAKYFFYSNLMNFFKRVIRYSNGKVVVRPVIECSKDTGEIAWNKQTDFEKVRRVLSYPQVNIVKKVETQTGGFSKESILPKGNSDKLIPRKTKKFRWDTPKYGGFDSPNIAYSVFVIADVEKGKAKKLKTVKELVGISIMERSSFEENPVVFLEKKGYQNVQEDNLIKLPKYSLFEFEGGRRRLLASASELQKGNEVVLSRHLVELLYHAHRVNSFNNSEHLKYVSEHKKEFGEVLSCVENFAKSYVDVEKNLGKIRAVADKIDTFSIEDISISFVNLLTLTALGAPADFNFLGEKIPRKRYTSTKECLNATLIHQSITGLYETRIDLSKLGEE

SEQ ID NO: 142 - protein, 1168 aa, Azospirillum sp.
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 143 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVKHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 144 - protein, 1024 aa, Helicobacter mustelae
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 145 - protein, 765 aa, Butyrivibrio fibrisolvens
MGITIGLDLGVASVGWAVVNDDYEILESCSNIFPSADASKNSERRGFRQGRRLTRRRKNRIHDFQKLWEDKGFVIPSQGTEDVLAIKIKGLSEKLSVDEVYWVLLNSLKHRGISYLDDADSGDNSSDYAKSISRNEEELKEKLPCEIQWERLQKYGAYRGNISIVEDGEPITLRNVFTTSAYKKEVEQFIDTQAKYNAQYSGDFKADYLEIFNRKREYYEGPGNELSRTDYGKYTTEINADGEYITVDNIFDKLVGKCSVNPDERRAAGASYTAQEFNVLNDLNNLTISSESSFIEDGKLTEDAKRKIIETIKNAKTVNVKKIICDVIGDKKCQISGARIDKNEKEIFHSFEAYNKMRRALEEIGFDISSLSRENLDLIGDILTLNTDRESILNAFNRKGIELADEAKDILVKVRKTNGSLFNKWQSFGLSIMNELIPELYAQPKNQMELLTAMGVFKSRGDRFLECKEIPGDLIVDDIYNPVVSKTVRITVRILNALIKKYGYPDRVVIEMPRDKNSDEEQQRLKKEQRDNENEIKDIKARVKTEYGREITEEDFRQHSKLSLKLKLWNEQQGICPYSGKSIKIDDLLDNPNLFEVDHIIPLSISFDDSRNNKVLVYSSENQDKGNRTPLAYLASVNRQWDIHSFMDYVLKTYAGAQKRKKRDNLLNEQDITKVEVLQGFVNRNINDTRYASKVVLNSLQEYFSSKECSTKVKVIRGSFTHQMRVNLKLKKTVMNHMFIMQLMQCLLLFHRWDMTLIMNLQISI

SEQ ID NO: 146 - protein, 1338 aa, Coprococcus catus
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 147 - protein, 1035 aa, Candidatus Puniceispirillum
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 148 - protein, 1270 aa, Mycoplasma gallisepticum
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 149 - protein, 1204 aa, Prevotella ruminicola
MERILGIDTGTNSLGWAIVDKDENQYHLVAKGTNIFSEGVKIEKGIESSKAAERTEHRSVRKHYWRRKIRKIRLLTILSDNDLCPRLKHEQLRQWRLKKVYPTDDTFMEWQRTEDKAQVNPYKFRYICLTQKLDLSDITQRFILGRALYHLNQRRGFLSNRKEATKESEGTVKEGISSLSKDMKDSGCEYLGEYFYQLYQQGKKIRNHYTARKEHYLKEFKAICSKQELDDALIEKLEKAIFDQRPLKSQKGQVGTCTFEKGKSRCPSSHPLYEDFRMYSFINNIKVQVDTLYDKGERSLTDEEKQLIIPLFKRKSKRTFPFEDIAKKIAGKNNYCYIKSNEEKAYKFNYQMDTQVSGSPVNAQLEEIFGEDWLSSVCEVYTLANNKSRFQIMNDVWHVLFFYDDEDKLKEFAKDRLQLDDELAEKFSKISIPNDYAALSLKAIRKIMPYLRDYGLIYSEAVFLANLVDVLPQHVWGIKEMREAAIENVIDVMHSYDKNNIDGITLEGCVKTFLKERYQVSDDNLKKLYHPSMLDPYPRQRPNDEGVFQLGSPRISSVKNPMAMHSLFRLRKVVNLMLKKGYITPDTKVHIEFSRDLNDANKRWAIQTWQRENEKERERCRKEIEKYIASPSDTDILKYQLWEEQNHKCLYTGDEIRITDFLGDNPKYDIEHTIPRSAGGDSTKMNLTLCSSRFNRDEKKTKLPAELVNHDEILERISNWKEKYEDIDKQIRKISTKGATSKEDKDSKIRRRHYLILQRDYWRGKYQRFTMTEVPEGFSRRQGTDISVISRYARMYLKSVFKQVYIVKGIATSDFRKMWGIQDEYAKKERVNHVHHCIDAITIACIGKAEYDKLADYRHQYDDYLFQGKTKPTFDKPWPSFVIDIKHIQDELLIAHYAKDNLEKFTKKNLRGKDGRIIRDKFGNKLQMKGDTSRNSLHNDKFYGAINHEGEIKYVYRTNIEALDAKSIGNIVDPTVRSIIESAIAIHGSLKAAINKGIWMNEEKHIPIKKVRVFRNDVKKPIELKDQRDLSDKDYKQHYYVTNDGNYMMLIFSKLNNKGREIRQHVVINSLEATEVIKSHKRSQVGKVVWESYYSKEGFDLIYKLKSGTMILLYENNRDEVWDLDIRNLQKRLYIITKMKYDGRIYMMHHQEAREKKDLEEKSGSFKINEDYRPLIVNSYNQFNALVQDLDFEINDLGEIRRLI

SEQ ID NO: 150 - protein, 1178 aa, Scardovia inopinata
MGKRHNSNMAKKKISYRIGIDVGLNSTGLAAIEVDDDGAPIRILNTMSVIHDGGVDPDAAKVRGTRLAISGIARRTRRMRRRRAKRLDRLEQILEKYGYTDTEPVLEEPYGPWICRAELADGFINDDEQRRMMIGIAIRHIARHRGWRNPYQNVRALLNIDDSDLSEEYKNLKEKVQDQINDGKDLPNFTPSQLVRDYLDNFSGQPAARIRTGKAGPRGNRRDAVGILPQRMRQSDYAYELQRIFDMQKIGRDEAQELLMAVFEAKSPKGSAEKRIGKDPLTGKKRALKASLAFQKYRIVATITNLRIKTGTGSERMLSPTELNDIYTYLLRVQDDNHLPTWEDICEEVLHIGRYQLAGIGKTFEGGERISNMPPVIQTSLAIHGLSEGTLAEKLTKWWDKADDDSRESMIKLLSNTVDIDRVNEVDENFASALDFIDSLDDEELTKLDKIALPRGRAAYSEEALNKLTADMLNTGDDLFSARQRIYHVNNSWRPPQPPIGEPLGNPAVDRVLKITNRYLMNCLNRWGQPRRVTIEHTRSGFTSVKQATEHQKISDKRAEYRRDIVKQLEEAGVESVHEYDIRRWEAVQRQNGQCLYCGRDITFKTCEMDHIVPRKGPGSTNTRTNFAAVCPECNRMKSNIPFASWAETKEAKDRGVSLDKAIKQVRFFNFTKNEYSPQAQRNFKKSMIERLKQKTSDEPLDNRSIESVSWMADELYKRIDWYFNHEQYETSKKAINDDKDNLSGTQVVVYPGSITAEARNAAGLGGNIHFIGGRYKTRLDRRHHAVDACVIAMMEPGIARILTERNQLRQAQRLTARIEDDEVNWKDYPTENTAGYNKYQAWSDRMHALLEYMNNALDYDKIPVVRWERLQLGNRSAHEDTIHPLKKLPLSHEISAIDINHASTPALYEALVSLPDFSEQDGLPADPSRQINVNGERYSGDDLVSFFNSNAAQIAIQGGSAELGTAFHHARIYRCWTVGKNGKKKIFFGMIRVYQHDLLHAKNEDLFTYPLKRSSVSMRYAKKEVVHAILSGNAEYVGYLCVGDELVLDLKGDKSNDEGGSRLSGQVGEFVQKFEEDSKVNSQIVNRWTVDGFPDEAKLRLRPSMFAGEGLKNMKSELVENAAIKNILSKTGWRVSVDVISKKSPVVLRRNAFGEPRWKTNAGLPVSYRWQDTETKE

SEQ ID NO: 151 - protein, 1371 aa, Gordonibacter pamelaeae
MNLRNVESYQVGLDIGTGSVGWAVLDDNGDLCRFKGKPTWGSRVFPTAETAAEARVHRGQRRRYDRRRQRIDLLQRFFADEVAKVDPEFFIRLNQARLHPENRDPAHADYRWPLFNGSNFTEKDYYRQFPTIYHLRAHLLKSDEPADIRLVYLALHNIVKHRGNFLHQDNPSLSARNANVGDAVEALCLALDEWCGAHDVECACDEAALAEALGDASLRPGEKRERAEAALGVEKAHKKLAKAVSSAVVGYAAEFGHVFFAESEGSKFALSNDEKVEAYVCPDEGRDLFDAMRAVHSSYVLMGILSEAQGELLSVCKVGEYERYKRDLETLKSLVRAYGPERYDEFFCGPFYEGTRDYDPGKAQGYTKYNLGASKLSHEDFLKEVQKLLKDIGAQADERYADIERAIEAGAFLRRLKTSDNGTIPYQLHLEEMDAIIERQAAFYPFLAQEKDKLKSLVSFRIPYYVGPLTQKNAARDGKGEARFAWSSRKPGMEDARVYPWNWEDVIDKDQSAEDFIRRMTGTCTYLKGEPVLARCSLDYELFCVLNELAGARWTQDGDKSYRFDAADRLGIVEDLFKKRKRVTYEAAEKWLARTHGPESGKSAGGAYHVSGGQGEDAFESQLSSHYDFCKILGVDELSDADEAMAEDIILWNTVFEDRSILKRKIKLAYGDRLGDAQVRKLCQKRYTGWGRLSGELLRGLRSATDNGPKTIMDILLEGDPNHARRMGAAMNLMEILHDDLLEFQAKIDEHNRERALAVGGMSVDEVTGSPALRRGINQALRVVDEIAGIAGKPPAHIYVEVTRDEGARNKGRRTTSRYRALEAALSSIKAQCADVYAELKERDPRALDDERLTLYFMQCGKCMYSGDALDINKLQTYQVDHILPQSYVKDDSFENKVLVRPDTNQRKGDTLLLDERLIARMRGFWRTLRDAELIGEKKFNNLTRTSVSDEQMKKFVSRQLVETGQMVKQVQQLLQARYPESEVQPVKAGVSHQLRVGCALAKSREINDFHHAHDAYLACQVGRFVQYRHSAVYSEPVKMAAVVKQFIKKQAEDYRRTRELPGSDGFIVSSFMTPGFDVKTGEVFRDAWDAGAEIDRIRRCFDYKDCFISRMPEETHGAFWDATIYSPRAAGKTLSLPLKRGLDPRKYGSYSREQFAYFFVYEAVKPKKKQRVLEFAPVPVRVASALANDPDALEDYARELAEAEGLVFERIRRRKVYKYQQIIVGDSRLYVTGREEVRNARQLAFSQDETKLICRIEQGEECEEGELLDLFRSMQRKYLACAPRLARLMKVAEMEEGFIAATASGKREVLLSLTSIAAAHRNSIDLKPIGRKGSSGQMKITFSKELSTNGILFVDSSVTGMFERRCRLGL

SEQ ID NO: 152 - protein, 1388 aa, Zunongwangia profunda
MKRILGLDLGTNSIGWALVNEAENEKEISKIIKLGVRVNPLTIDEKTNFEKGRPLSTNADRTLKRGARRNLQRYKLRRENLIEILIDNHIITKETPLTEIGKGTTYQTLSLRAKAVRERIDLEDFAKVLLAINKKRGYKSSRKASNDEEGQAIDGMAIAKELYERGITPGQYVLELLENDRKYIPDFYRSDLKQEFNKIWNNQKTFYPEILTDELFKELDGKNKSQTWAICQKPFNIKGIKRITKGREKTIENYHWRVKGLSGKLNLEKLAIILQEINNDINQSSGYLGGISDKSKKLYLNKETVGEFLYKQIAKNPHTSLKNQVFYRHDYLDEFEQIWKTQSNFNANLTDELKQEIRDVIIFYQRKIKSQKSLISFCQFESWEQEYFDKETGKTKTRTVGRRVIPKSSPLFQEFKIWQNLNHLVFTNSETDEKIEIKEVEQEIRKELFEELNLRGDLNPNDLLKILRSQFKIGKLSNWKCNFEKIEGNRTNAALFNIYQKISDFEGYGIDWNKSNAKKIRKELKATFPEIGIDASILEFDAYKKQLTNQSSYELWHLLYSAEEDFKISEQDKLIYGNSSVSLKKKLHLKFGFNPEYAKMLANLSLMSDYGNLSAKAIKKILPYLEDGHLYSEACRLAGYNHSKSLTAEELEKFEPKAKLDLLKKNSLRNPVVEKILNQMVNVVNQVIDTYGKPDGVRIELARELKKSAKERAEMTKGIADGTRRNEEIKKIITQKFGIPNPTKSDLVRYRLWQELESRGYKDIFTDKYISPDKIFSSEIDIEHIIPKALLFDDSFSNKTLSFRNVNLKKANRTALDFITQDYQSNVEAYKERVETWNKDNHISKGKRNKLLMSLKDIPDGFIERDLRNSQYIARKAKRMLYEVFPNEVLATSGSITDKLRSDWDLINVMKELNLPKYKALGLTEYEERLDKGTEELFKHEVIKDWTKRNDHRHHAMDALAVAFTTHNHIQYINNLNARKDITQDNHPIIKNIENLITEVNSKGKRVFKAPMSSFRESAKEQIEAILVSFKNKNKVVTKNINQTKKEGGFNYQNAKTPRGQLHKETIYGKSKQPLEKPVKINNRFCKKQVGLIINFKEQEAVLHHLKKYDNNEKIAFSNKTLKSDPIQVNGSPLREVKIFEEIFTIRKDINPDNFKTQKHLDKIIDKGIKEVMKKRLEEYNGDFKTAFSDLDKNPIWLNQSKGITIKRATISGVTNAEPLHQAKDHLGNIILDDNGKEIPIDYVSTGNNHHVAIYQDESGNLQEEVVSFYEAVIRKNQDQPIIKKRHPKGWKFLFTMKQNEMFVFSSENFNPSEIDLLDEKNAAIISPNLFRVQKIATKNYMFRHHLETEVTNNLDFTYRHFQATEWLRNLCKVRIDHIGRIVQIGEY

SEQ ID NO: 153 - protein, 1082 aa, Methylosinus trichosporium
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 154 - protein, 1186 aa, Gardnerella vaginalis
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFTPWIFRAKLADEYIADEKQRKQMLSVAIRHIARHRGWRNPYQSIKSMTQETEYSEFYNELLKNIEKFAPGVSCEGSTPAQLVRDYLLSQQGKASRRLRITTDDRRKNHPNSLDPVLPRKLMQSDNMLEILNIFNVQHIDNKYVREQIINAVFYAKSPRGSAENRVGKDAITGKGKRALKASLAFQKYRIISTISNLRIRENSKERCLTIEEKQSVYKLLTTSTDEYSKEKSAEAPLYTWIDVADCLGIERYKLRGVGSQIEDGESVGNRPPMLNSELAILYANAKSLKQSLITWWLAANRTQEDKEAFIEILSNTVDIEAIHDNPEYQDKYGSVIAFIDSMDETEIAALENISLPNGRAAYSLETLDKLNKQMLETDDDLFEARKKLFNLPNNWRPSEAPIAEPTGNPSVDRVLKIVHRFLISAKNRWGNPERINIEHVRSGFQSKKMANSYKKLLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEESTYCKNHDISVDSAINRVRAFIFPPNSYDKRGASQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLELLNEEMRADRIAVVNSIRLRYSNSSVHKDDVHALLKLHVGDEIDSETIRRASTPALYCALTRNPDYDVNNGLPENTDRTILLHDKKLNADDSITFFKSKAAQLFVREGSVEIGNSIHHLRIYEYFEKLKSGKVKKSYGMIRVFQDDLHRYIHEDLFSCDLPEQSISMRYADTKVAHAVQTGNANYLGYLVPGDEIIVDFSHVKLSGYIGEFVEFLNKIGANCAAYKHWVVAGTDDKTTLILKPSMISSEGIDKLYSNCERNNFDYASYEKSIDKILVDKGWRVSVNVLDQYKAATIRRNALGEPRWASRSHLPISWSWDTGENRE

SEQ ID NO: 155 - protein, 1434 aa, Bacteroidetes oral
MKNILGLDLGTNSIGWAYVKQAQNDSEKSEIAELGVRVNPLTVDEKTNFEKGKPISTNADRTLKRGARRNLQRYKLRRQELIELLKDYQVISDKTILAEDGKETTFETLRLRVKSAKEQVSLEELARILLMINKKRGYKSSRKAKNEDEGQLIDGMEIARRLYDENLTTGQLSLQLLKEGKKSLPDYYRSDLQHELDKVWNFQKQFHPDILTDEFYTSIQGKGQKATRESFSSKYGIDTAENKGSREEKKLQAYQWRADATHKELTKEELAFVITEINNNINNSSGYLGAISDRSKELIFANETVGEYLWKQIQNDPHTSLKNQVFYRQDYFDEFERIWETQSGFYPQILTESLKNELRDILIFYQRKLKSQKALVSICEFESKEIPLKDKQGNPISKNGIPVTKLVGPKVAPKSSPLFQEFKIWQNLNNVLVRPKGSRKRKVTTNQQSTLLEGQEPVFELNLEQKELLFEELNLKGNLKTDYCLELIGYSAKEWEMNYPTLEGNKTNKALYEAYLKIIDSEGYDAKKLLKVKTDKDDINLDDIKVSASEIKTMISDIFNELGINTKILDFDAELERKQFEAQASYRLWHLLYSYEGDDSKSGNELLYRLLEDKFGFKREHSKTLANVSLLSDYGNLSTKAIRTIYPYIKENKFSTACELAGYRHSKLSISKEENENRTLKDTLDVLKKNSLRQPVVEKILNQMINLINELIEKHSEKDEKGNIVKYFKFDEIHIELARELKKNAEERRELDSKVREGKDRNEKIITILKSEFGLPYPTKNDITRYRLYEELKDNGYKDLYTNTYIPREKLFSKEIDIEHIIPKSRLFNDSFSNKTICYRQDNLNKGERTAYDYIEGLGKTQLDEYLNRVENLYTNKFITKAKYRNLLKKESEIGDGFIERDLRETQYIAKKAKEMLLQITRHVVSTTGSITDRLRDDWELVNVMRELNLPKYKVLGLTEIQERKNGQTVEVITDWTKRNDHRHHAMDALTVAFTKHSHIQYLNFLNARKDEKHKEYSNIMGIQQLETEKTTDKDGKDRRVFKTPIPNFRQVAKEHLESILISHKTKNKVVTRATNKIAGSKKQQETLSPRGQLHKETVYGKYRRYVQKEEKIGSKFDLQTIERVANPLYKRLLTKRLEENGGDPKKAFTGKNALAKSPIYLDETQTQQLPEKVKLVWLETDFSIRKDITPDNFKDEKSIDKVLDEGIKRILKDRLKSFDGDAKRAFTDLEQNPIWLNKEKGIAIKRVTISGVSNAEPLHTKKDHLGNEIFDDTGKPIPVDYVSTGNNHHIAIYRDENGNLQEKAVSFFEAVTRANQGLPTVDKTYNQHLGWQFLFTMKQNEMFVFPNKETGFDPQEIDLLDPKNKKLISPNLFRVQKISTKNYFFRHHLETSVETHNALNGVTYKSQLGLNGITDIIKVRINHLGDIVHIGEY

SEQ ID NO: 156 - protein, 1341 aa, Peptoniphilus sp.
MWGSRLFEEASTAQDRREHRSNRRRLERRKYRLDLLEELFVEEINKIDPEFFIRLRESKFHFEDRSLKNTFILFNDKMEGGYNDKVFFSKYPTIYHLRSALINGNKEDVRAVFLAIHNILKNRGHFLLAGNDINISLSLNDTLTDLFEYLKIHLGIEVEFENKLKDIEKIALDKNLSKSDKQKKIVQLLETDYKKQLADVFKLSLGLTANMENIFGKENEQGLEFINAENKIKKIQFDSSYEENIAEFDQFYGEYFEIIDICKKIYDAISLSQILVDGKGLSESKVLSYEKHKEDLKLLKKVLKNIDKAYDNKGEDRLVYKVLKEDKDKGTNYVNYSKLSNNGTATTKEEFYKFLSKNLDLKKFGKLNKEDIETLDYINSEILLGRFLPLQKEKINGVIPYQLQMKELTQILNNASKYLPFLNKIEDGMTVKDKIISLIKFRIPYYVGPLNEYNRIENGNGFAWIEKKKNEKIFPWNFNDVVDIEKSAEKFINNLTNKCTYIKEETVLPKNSIIYSKFMVLNELNNLQYGNKKLDIELKMKMYTDLFLEKKDNRKVTEKRILEYFRINGINDGKEKLTGLNNEIHADMKSYRDMCEIMGENFNINVAENIINWITVFHGEKKILINKIKNVYGKMFNDEQISKLSKLNYSDWGRLSKKLLTDIKCYIDADGINFPVSILEAMEVSNKNLMELLSNKYEFISCIDDINNKYFGDRDISASELIDELYVSPAVKRGIWQSVRILEEIVSIIGHNPKKIFIEMTRHNEEKVQKSSRRHNLEELYKAIRKDPEYVELIKEFDSTTDTDSFKIKKLYLYFMQLGKCAYSKEKIDFDKLFTDSYDIDHIYPRSKTKDDSIHNNLVLVKAKYNREKTDVYPIDINIQKNMNSFWNFLYTKKFITEEKYKRLIRTSDLTDEELAKFISRQLVETSQSTKATAEVLKQIYGDSDICYVKAENVSDFRYGSSRQKDKNDIQKLFVKCREVNHFHHAKDAYLNIVVGNVYDVKFTKNPVNFIKKNKMGNKSNYSLNHMFCFDVERNGYKAWDSSETIKTVGRMMKSNDVRITKHVHPTRGELYDATIYKAKIAKTGSYMPLKSSKNTPLSDVTKYGGYTKIKIAYYSVYKYKFSDKNLIKTEIRLIPIPIYLSKNDDDIKEYVKNYLNDRVNSKLIDFTKIYDKLYVNSLIKINGYLYYLGGKTNDRVWIDNAVSIVLDDKIEYLIKRISNDIKYGYEINVSDDELMDIYESLAEKANKKIFYNRLSDFEKIFSNMDVKKKFVKLEKNDKCRVLLQLLNVLTDSQTTYKLEMVGLKHSRSNIGMKISNLEEFKVINSSITGLYSNEIDILNI

SEQ ID NO: 157 - protein, 1391 aa, Lactobacillus gasseri
MTKIKNEYIVGLDVGTNSCGWVAMDFQNTILRMHGKTAIGSHLFDAGNSAADRRAFRTTRRRIKRRKWRLKLLEEIFDPYMTEVDPYFFARLKESGLSPLDKRKNVSSIVFPTALEDKKFYCNYPTIYHLRYDLMSEDKKFDLREIYLAIHHIVKYRGNFLYNTPVKDFEASKIDVKDSLEKLNELYERLDSEFTVELDSSNALEIEKIIRDKKVFKINKVKSIHQLLSLKTENKERTKLIKDVSKQIINAILGYKTKFETILLKNISKDEADDWEFKLTDVDADNKFENLIGDLNENEQEILLEIRNLANAITLSNIVEEGKTLSESMIDKYNKHSDDLELLKQVISDHPDRDKAKKLALAYDLYVNNRHGKLLQAKDVLGSKKTLSKEDFYKEVKKNLDDSKASQEILDTIALDSFMPKQRTNENGVIPYQLHQLELDRIIKNQGKYYPFLKEVNPVSSHLKEAPYKLDELIRFRVPYYVGPLISPNESTKNKQTKKNQNFAWMIRKEQGQITPWNFDQKVDRMASANKFIKRMTTKDTYLLGEDVLPANSLLYQKFTVLNELNNIKINGKRISVPLKEELYNNLFKKNSTVTTNKLKSYLKENYNLINVEIKGLADEKKFNSGLTTYNKLRNLKIFDQQLDDLNYDKDFERIIEWSTIFEDKAIYKDKLKTIKWLSDRQIDKLSKIRMQGWGQLSKKLLSQLTDNNGQTIIEQLWDSQNNFMQIVNQSDFKDAIAVANQNLLVNTSVEDILNEAYTSPANKKAIRQVVKVVDDIVKAASGKVPKQIAIEFTRDADDKAKISQTRANKLRKVYKELSNELASETIRNELERVAKDQKLLKDKYYLYFMQLGRDAYTGEPINIDDLGQYDIDHILPQSFIKDDSLENRVLVKKAVNNGKSDNVPVKLYGNRMAADLGMTIRHMWEKWKDQGLITKTKYNNLIIDPDKINKYESSGFIHRQLVETSQIIKLVSTILQSKYPDTEIIVVKARYNHYLRKHLNLYKSREVNDYHHAIDAYLSAICGNLLYQVYPYLRPFFVYGQYKKFSSDPKKEKIIYDKTRKYNFISQIFENKSNDIISLETKKKVFDKKDIIEKLKHAYNYKYMLVSRETETHDQEMFKMTVYPRLSRDTKKSRNLISKKKDMPTEIYGGYTNNSDAYMVIARINKKKGTEYRVFGVPMRELVNLRKAEKNGRYNAYLKQVLEPEIMYSKNGKKNKTISSFEIVKAKVPYKQVILDGDKKFMLASSTYVQNAKQLTLSQNSMQAITDNCENDTEEEKALEEKALIEAYDEILTNIDKYLPLFDINKFREKLHAGREKFINLSLDVKKDTILQVLNGLHDNAVMPKIKSLGLSTPLGFMQFSSGVPLSENAKLIYQSPTGLFEKRVKISDL

SEQ ID NO: 158 - protein, 1426 aa, Sphingobacterium spiritivorum
MKHILGLDLGTNSIGWALIKQDFENKQGEILGMGSRIIPMSQDILGDFGKGNSVSQTAERTKYRSVRRLRERFLLRRERLHRILNVLGFLPEHYASQIDFTKRFGKFKEETEPKLVYSNEGFIFKKSFEEMLSDFKTHQPQLLEDNKKIPYDWTIYYLRKKALSRKIEKEELAWILLNFNQKRGYYQLRGEEEEENPNKLIEFYSLKIVDVLADEPQKGKSDIWYSLILENGWIYRRSSKTPLFDWKEKTRDFIVTIDLNDDGSVKTDKEGNEKRSFRAPGENDWTLVKKKTEQEIDSSRKTVGTYIYETLLKNPKQKIKGKLVRTIERKFYKTELKQILEKQKEFHPELRQDDLYSDCVRELYKNNEAHQLTLSKKDFVHLFMEDIIFYQRPLGSQKSSISNCTLEFRKYKDENGTEHTQYLKAIPKSNPYYQEFRIWQWMYNLNIYKKEDDTNVTKDFLNTKADFESLFEFLNNRKEVDQKALLKHFKLNDKTHRWNYVEDKKYPCNETKTMILSRLDKVENISDDFLTREMEQKIWHIIYSVNDKVEYEKALKSFAGKNNLEDNSFFEAFKKFPPFKSEYGAFSEKAIKKLLPLMRMGKFWNYNNISEQSKSRIQKIITGEYDENIKDKVREKAIHLTTETDFQGLQLWLVQYIVYGRHSEAAMLGKWNSADDLEEFLKEFKQHSLRNPIVEQVITETLRVVKDIWQKYGNGAKDFFREIHIELGREMKLPAEERERLTRQISENENTNFRIKALLAEMMDDNSVENVRPFSPMQQEILKIYEEGVLNSDIEIEDDILKISKTAQPSSSDLKRYKLWLEQKYKSPYTGQIIPLNKLFTPEYEIEHIIPQSRYFDDSFTNKIICESAVNKLKDNYIGLEFIKKLGGSIVECGNGKSVAILKHDAYEDFIKKHYANNRSKRNKLLLEDIPEKMIERQMNDTRYISKYISGVLSNIVRVEDGTDEGVNSKNIVPGNGKITTQLKQDWGLNDVWNDLILPRFERMNHLTNSTDFTAWNENHQKFLPTVPVEFSKGFSKKRIDHRHHALDALVIACATKDHVNLLNNQSAKSDTKRYDLKKKLMKFEKVAYNHPQTGERIEREAPKQFLKPWETFTIDAKNHLETIIVSFKQNLRVINKATNYYEKYVEKEGTKVKERVEQKGTNWAIRKPMHKETVSGKIDLPRIKVPKGKILTATRKSLDTSFNLKTIGSITDTGIQKILKNYLQYKDNNPELAFSPEGIEDMNKNIEKFNNGKAHQSISKVRVFELGSKFPLGQSGNKKEKYVEAAKGTNLFFAIYQDKNGKRSYETIPLNEVIERQKQGLSVVDLKGVDDFYLSPNDLVYVPSEDELENISMIDFNKMSSERIYKVVSFTGNQIFFVRQDIATSVVNKAEFSTLNKMERAIDGTMIKETCVKLQIDRLGNISKI

SEQ ID NO: 159 - protein, 1361 aa, Lactobacillus casei; identical to SEQ ID NO: 75

SEQ ID NO: 160 - protein, 1436 aa, Bacteroides fragilis
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKLAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDENPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGQPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 161 - protein, 1517 aa, Bacteroides sp.
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 162 - protein, 1399 aa, Olsenella uli
MNLRNTTDEYNIGLDMGTNSVGWAVTDKAGAIAHFKGKPTLGSRLFDAAQTAAGARIHRSQRRRYVRRRWRLDLLQSLFQDEVSKVDSEFFCRLRQSRLYVGDREKGHADYTWPIFNDSDFNEVDYYKRFPTIYHLRKWLMETDEKADIRLIYLATHNIVKHRGNFLRENNKSLSSRDANPAQAVKSLRLALNDWCSERDYECAWKGEEDDGAIDEAILNVLADGEKGRSDQAKEIAKLTGVDCGDAKQSKQCNEAIAKAIVGLKVEMKNIFGEFPAEKTSYIYLSSDEDVEAVRESCPDDSGELFQALCKLYSAYILQELLSYADPSGQTISANMVAKYKQYGRDLRLLKELTRTYAPQKYDLFFRGETYAGSSDYVVDEARGYTRYNLGTTKANYDDFQKSVKELFKGTDALQDERYQEMMVAFGEQKFLRRLKTSDNGSIYYQLHLEELHTILENQGKHYPFLLSEEDKIESLVSFRIPYYVGPLTRKNAAIGHDGKERFAWSSRKDGMEHAVITPWNWEEIIDRDKSAEDFIMRMTGDCTYLQGEPVLPKCSLLYEEFCALNEFNGAHWTVDGDDERRFDAAQRERIMCDLFRRTRSVTYNKVSDWLERKYNFTGARVRGGQGEHGFESKLGSYIFFCKDVFKTDGLDEADYTMIEQIILWSTLFEDRDILKRKIEEAYGGDRLTSEQIKVICKKRFTGWGRLSKRLLTDIKVNTDTGRKSIMDVLREGNPNNGQRSRTMVFMEVLRDEDLGFQKAIDGLNRDYFREHNNGLMDVNDLPGSPAIRRSINQAVRIVDEIASIARKEPTNIFIEVTREEDDPRKKGKRTKRRYDAIKSALEKFKKDDPSLWKELCEKAPGDMDERLSLYFMQRGKCMYSGRPIKIEELHTGKYEVDHIIPRSYIKDDSFENKVLVYREENQHKTDALLIDSSIRQKMGGYWRMLHDAKLVGDKKFRNLFRNHIDDKAMKGFVARQIVETSQMVKLVQTLFEARYPNTRIVPVKAGISHDLREAAGLVKCREANDFHHAHDAFLACRIGLFIQKRHPSVYDNPIGLARIMRDYARMQAREYKKSHCLAHTQGFIVNSFLSSGFDEETGEIFKDDWDAKAEVEGIRRVLNCRQCFISRMPVEGDTRYGGRYWGETIYSPKGKHKHEIPLKQGLDPNLYGGYSDLLYSYFLIYEASDVSSGERVLRFIGIPTSIAARMANQKRLEEYVSRLALQENLEHVRMVRKIMKKQLIEVDNCRLLVTAADAVTNATELAFSLDEMKIISTCAKCINGADPSAIDKIGNAQDSFFDNLKRRGSDRCALLFSQLKLDKLSQNFYMISSDDKSKILISILDRIRAKSNSVDLSLVGGAKHAAQMKFDFNAKLNNPASSFVLIDQSVTGMFERRTRIGL

SEQ ID NO: 163 - protein, 1398 aa, Veillonella atypica
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLSNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 164 - protein, 795 aa, Prevotella disiens
MEKQRILGLDPGTNSLGWAVLDFDNSKQEYNLVRKGEVIFEEGVGKSKRGEFSKAAYRTFYKSTRKHYFRRRLRKIEVLKVLVKYDFCPYLSDDLLKQWHEKKIYPAVKEFMDWQRTSDAEGKNPYYDRHCCLNEKLDLSLKSDRYVLGRALYHLTQRRGFKSNRLIQNNDENEEGKVKKGISELSTEMQEANCNYLGDYFYKLYTEKGNTVQIRKRYTDREKHYKNEFNAICEKQELNETIVKELDKAIFFQRKLKPQRHGVGKCTFEPNNRRCAISHPDFERFRMLCFINNIKIKTPFEENLRPLNNEEKALIEPLFYRKSIKNFDFEEIAKKLAGKNNYCYIKDDSSKQYKFNYRMSQGASTCQTIAKLKSIFGEEWKNGIAETYTNRRKKEGLKKQAEMVDDIWNVLYSVSECDVLKDFAINKLQLDEKTADNFSKTKLAQGFATLSLKAIRKILPFLEQGFGYTEAVFLANIPTVVGKEYWNNEDIRNDIMEEIKTIFYHNTLKTNDSHNTILFCIKDILSNNFDLAPGAIDKLYHPSMINVYKDVIPNEDGILQLGSPKIDAVKNPMAMRSLHIIRKVVNELLREGIINSDTEVRIEYARELNDANKRHAIADWQKKQYGKHQKYRKEIKELFKAETGFEIEPNETDILKFELWEEQNHICLYTGQEIGISEFVGENPKYDIEHTIPRSLGGDSTKMNMTLCENKFNRENKQKKLPSELANHSEILERIDDWKKKIYILQKKYDSIRTHNGMDKENKDKKIVSMQVRISGSSICVYSQNTLLWLQYGYN

SEQ ID NO: 165 - protein, 1428 aa, Burkholderiales bacterium
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRKGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVHSICNAIENERKTYGPYFSEDYKFVKTALKEGKTEKELSKKFAAVIKVLKMVSEVVPFIGKELRLSDEAQSKFDNPYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGASDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 166 - protein, 1025 aa, gamma proteobacterium
MGGYMPQLMRYRLALDIGSTSIGWAMIRLSMQNEPIAIIRMGVRIFSDGRNPKDGSSLAVTRRVARQMRRRRDRLLKRKTRLLNALVQKKFFPEDADARKALVVLNPYELRKEGLYRQLSGPEFGRALFHISQRRGFLSNRKTDKKDNDSSVLKKAIVDLRQQLEVENCQTIGEWLFKQQQSGKSVRARLRGKTQKDKAYDFYIDRAMIAHEFDTLWVSQAKYDPLLFNEDARAILRDILLYQRPLKPVKPGRCTLIPDESRAPLALPLTQQARIYQELNHLRITTPALGAQALTVAQRNTIAALLEKSDVTFVKIAKALGLTSTTEFNLQDIKRDRLKGNATAIILARNQYFGRRWHDFNADLQNLIVDKLVNEGSETALIEWLKANTDVDESAAERVSGVTLPEGYGSLSVAALRRLLPALKEDVVVYSEAVKRAGFDSHSALSLIEQTGELYQELPYYGEVLQRHVGFGSGDPNDSPERRFGKIANPTVHIGLNELRKIINALIKRYGNPAEVVVELARDLKLSREKRKEIQEEQKQRQDRNEKRIKDACEILGIDPLVIDRGKRREISQKMQLWDELNPKDAANRRCPYTGDQISIEKLLSAEVEIEHILPFSKTLDDSLNNKTVAMRRANRDKGNRTPYEAFGESLNPDYDYDAILQRASLMPREKRKRFASDGYQQWLRDDKDFLSRALNDTAYLSRIAKEYLTLICPPNSVRAIPGRMTAQLRAMFGLNRLLSEGGIKNREDHRHHAIDAAVIGVTDQGLLQKFSRASARTRELQLSRLVDDMPLPWDTYREHVTRALEHLVVSHKPDHGYQGKMHEDTAWGLRDNGQVTRRVRSEDGGPRQRLLENKNVVKINSTRDFSRHGIDEQGQVNAYKGYVGGSNYCIEIWIDEKGKWNSDVVSTFQAYQIVRELGEKAAWQKLRNPLLSLSAKPLVMRLIIDDVVKMQIAGQNKIMRVVKIAQNGQIFFAEHNEANVDARDKDKNNPFKYISKTAGSLQKAGGIHMAISPIGDARPVRYGR

SEQ ID NO: 167 - protein, 1364 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEKDRKFDFREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNGENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTGNFMQIQSRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLQPYFVYDNFKKFGNKEDIGHKRFNFLGKIEREKKVVAPETGEILWSNVAPNETIKQIKKVYDYKFMIVSREITTRRAELFNQTVYPKNYHGKLIPIKEDRPTDLYGGYSGNTDAYLAIVALEDKKKGKYFKVVGIPTRVAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 168 - protein, 1364 aa, Peptoniphilus duerdenii
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 169 - protein, 1089 aa, Corynebacterium matruchotii
MNSANVNYRVGIDVGSYSLGMAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQAGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 170 - protein, 1134 aa, Streptococcus mitis
MNGLVLGLDIGIASEGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKLRLINVFSTSAYKKEAERILRKQQEFNNQITDEFIEDYLKILTGKRKYYHGPGNEKSRTDYGRFRTDGTTLDNIFGILIGKCTFYPEEYRASKASYTAQEFNLLNDLNNLTVPTETKKLSEEQKKVIVEYAKEAKTLGASTLLKYIAKMIDASVDQIRGYRVDVNNKPEMHTFEVYRKMQSLETISVGELSRNVLDELAHILTLNTEREGMEEAINTKLKDSFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPDNIFHGHKELATKIRLWHQQGEKCLYTGKTIPISDLIYNQYKYEIDHILPLSLSFDDSLSNKVLALATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKTGKLVDFNPFEKYRQENEPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGDKPKLKF

SEQ ID NO: 171 - protein, 1373 aa, Streptococcus bovis
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFQRLDESFLRWDDDNKKLGRYPIFGNKADVVKYHQEFPTIYHLRKHLADSSEKADLRLVYLALAHMIKFRGHFLIEGELNAENTDVQKIFADFVGVYDRTFDDSHLSEITVDAASILTEKISKSRRLENLIKYYPTEKKNTLFGNLIALALGLQPNFKMNFKLSEDAKLQFSKDSYEEDLGELLGKIGDDYADLFTSAKNLYDAILLSGILIVDDNSTKAPLSASMIKRYVEHQEDLEKLKEFIKANKSELYHDIFKDKNKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKDSRFSWAEYHSDEKITPWNFDKVIDKEKSAEKFITRMTLNDLYLPEEKVLPKHSHVYETYAVYNELTKIKYVNEQGKDSFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTADQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQNSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTESDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKRVIRYSNGKVIVRPVVEYSKDTEDIAWDKKSNFRTICKVLSYPQVNIVKKVETQTGGFSKESILPKGDSDKLIPRKTKKAYWDTKKYGGFDSPTVAYSVFVVADVEKGKAKKLKTVKELVGISIMERSFFEENPVEFLENKGYHNIREDKLIKLPKYSLFEFEGGKRRLLASASELQKGNEMVIPGHLVKLLYHAQRINSFNSTKYLDYVSAHKKEFEKVLSCVEDFANLYVDVEKNLSKIRAVADSMDNFSIEEISNSFINLLTLTALGAPADFNFLGEKIPRKRYTSTKECLNATLIHQSITGLYETRIDLSKIGEE

SEQ ID NO: 172 - protein, 1099 aa, Corynebacterium accolens
MSLLYRVGIDVGTYSLGCTAIEVDDNDQPVSILSSVSLIHDSGLDPDQQKRAVTRLASSGVARRTRRLYRRRRRRMVKLENFLTAQGWETLPFERYSDPYLPWHARVALVNGYISDDTQRGQYLSIAFRHIANHRGWRNPYWKVSSLYSPDKPSDAFEQIRKELEASTGRQIPETATVGQLISFAQFGKDRLRGGGKQKDKKKPQEQVNQAVISARLHQIDHAREINEICRVQKIDDTLRKQILDLVFAAESPKGAQKGRVGKDPLQPKLFRALKASDAFQQYRIAALTGNLRIYRNGVTVPLDRDEKLIVFNYLVNLPKKEEPSWLKIAEILNIDRGQLRGTATMTDDGERAGATPPVHDTNRTILDSKVKPLAHWWENASDDERAAMLKSLSNSEVEDFDSPAGAQVQAFFADLDETEQEKLDSLHLPMGRAAYSEDTLMRLTNRMLDENLDLYEARLAEFGIPKDWAPPAPRIGEPVGNPAVDRVLKGVARWLEAAADEWGAPKSVVIEHVRDGFVSKSKAIEIDRANNNRHKRNRELFQKMQENLGIEGKVRSSDLWRYQSVQRQNCQCAYCGSPITYTTCEMDHIVPRAGEGSTNTRDNLVATCHRCNLAKKNIPFAVWAEKSTIPGVSVKEALDRTRHWSEDSGMSKKDFQKFRKNVCERLNRTVVDEPLDARSMESVAWMANELRGRVAQRFQEENTTVNVYRGALTAEARRAAGITDKLRFIDGTGKSRLDRRHHAVDAAVVAFIHNYVAETLAIRSNKKREAQLLQGTSQWKEFTGSDDKHRAVWNAWIPKMQKLAVLLQIALDEDRIVVTSNLRLRLGNGRAHEDTISELKTIRVGDAISVTDIDRASSEALWCALTREPDFDEKDGLPENPNRRIRVHGTWYDAEDEIEVFPVGAGAIKVRGGYAKLSRFHHARVYKIPGKKAPIYCMLRVYNTDLVQHRHEDLFSVELKPQTMSVRQAEPKLRKALAENTAEYLGWLVTDDELIIDTSTFRTGLIEEMQSEFGLVRRWRLDGFDSPSLLTLRPLHMSAEGLPDDCALGSRKIIDTKGWRVSINKVFNAGNTTVVRRDALGRARLTSNAHLPISWKEE

SEQ ID NO: 173 - protein, 1054 aa, Actinobacillus pleuropneumoniae
MKLTPLNYILGLDLGIASVGWAVVEIDEQENPLGLIDVGVRTFDRAEVAKTGESLALARRLARSSRRLVKRRADRIKKVKRLLKSENILLSADEQLPNDVWQLRVKGLDQKLERQEWAAVLLHLLKHRGYLSQRKNESKSENKELGALRSGVAANHQILQSAEYRTPAEIAVKKFHVEEGHIRNQRGAYTHTFSRLDLLAEIELLFTRQTELGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKHRESAVQKFKEYFPNFVGEPKGKDILKMRLYELQQAKCLYSGKSLELHRLLEKGYVEVDHALPFSRTWDDSFNNKVLVLANENQNKGNLTPYEWLDGKNNSEPWQNFVARVQTSGFSHTKKQRILSHKLDEKGFIERNLNDTRYVVRFLCNFIADNMLLTGKGKRKVFASNGQITALLRGRWGLQKVRDDNDRHHALDAVVVACSTVAMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLNDLERMVNREREMALYESLKVRLEQFDNDPAKAFAEPFYKKGGALVKAVRVEQTQKSGVLVRDGNGVADNASMVRVDVFTKAGKYFLVPIYTWQVAKGILPNKAVTANVDEIDWLEMDESYQFIFTMYPNDLVKVKLKKEEFFGYYGGLDRATGAIVIKEHDLEKSKGRQGIYRIGVKLALSFEKYQVDELGKNIRPCRPTKRQHVR

SEQ ID NO: 174 - protein, 1369 aa, Lactobacillus iners
MNNNYYLGLDLGTNSVGWAVTDDHYNIIKFHGKHMWGMRLFEEAETAKDRRLHRQARRRRQRLVERINLLEELFDKEISKVDQGFFARKKESDLHFEDKTTKSEYALFNDKSYTDRDYYKQYPTIFHLIMDLIENDKKRDIRLVYLACHYLIKHRGHFIFDGKNFTVDNSFENLLDKLITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKILDNQSKYYDFLLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKVDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 175 - protein, 1420 aa, Bifidobacterium bifidum
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 176 - protein, 1092 aa, Ilyobacter polytropus
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 177 - protein, 994 aa, Streptococcus downei
MENQRGKRQRITHQEPYSIGLDIGTASVGSAVINNDLTVPQKRFKVRDINGNVIKTIKKNMSSVLIFDEANPAKGARTKRTSRRRYTRRNFRLLELKKLFEKEIEKIDPNFFHRIKEDSFFNWNDKEFDKHPLFGNLKEEKKFHNNYPTVFHLRNEIGKNSSKKFDLRLVYLALAHIIKYRGHFLDETFDPDASVSVEKRLNDFIVEYNELFDKDLRSEAKFSEILMSDSSNSVKIESTLSLYPSEKNTIFQVFLKLIVGNQGDFNKFFKDELESSSHSGKLVFSSDEVEDEKEELISIIGEDYLDIINLCQSLYSTVALAKIISTDTGESNTPLSASMVKRYNEHKGDLANLKGIVKHFIPEKYEEVFGEHSKTGYTAYIRNPNKMPEKKFYDYLYHEGEKGKISGILSDSRIYELPAVQKFILKIEQKSFLKKQRTKENGLIPYQLHLKELKIIIENQSEYYPFLHEIEEKLEKLLTFRIPYFVGPLAQTKYINPRFNWLVRKSEDHIKPWNFSEIVDEEKSATKFIEKLISNDQFLFGEKVLPKRSIIYQQFLIFNELTKVSYQIKDGPSRNFDSETKEEIFNSLFKKNKLGCVTVVDLKNYIKNDQCLSEKEDIQIEGIKKKFNSSYSTYADLSEISGLKELLDDDTQLDLVEEIIRILTVFEDKKMRTKQLEKLNLPANVDIEKLCKKHYKGWANVSRQLIDGIADRSRGFKKTILDYLKDDDIPNNDAFSTKVQKSLNRNFAQLITDKSLDFARKLDESYKIDVKKDYPSLVEDIPGSPAIRRAILQSLYTVDEIIGVMGRMPKNIVIEMARTNEVSDSPKTRKERIKKLIKETENDADALNFGISKVSEIFDEVKKDENLFKELEVYLYFLQEGKDMYGTETREGHRQPKEINFYDVKNSTGKYHIDHIIPQSLYSGNPLDNIVLTESTNNKIKDKDVPDEATVYEMKNFWLYLMKKGAISKKKFSFLTKIEQGGLSNEDKFGFINR

SEQ ID NO: 178 - protein, 1052 aa, Aminomonas paucivorans
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 179 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 180 - protein, 874 aa, Listeria seeligeri
LANGQSEFSWLTRKADGEIRPWNIEEKVDFGKSAIDFIEKMTNKDTYLPKENVLPKHSMCYQKYMVYNELTKIRYTDDQGKTHYFSGQEKQQIFNDLFKQKRKVKKKDLELFLYNMNHVESPTVEGVEDAFNSSFTTYHDLQKVGVPQEILDDPLNTEMLEEIIKILTVFEDKRMINERLQEFSNVLDEAVLKKLERRHYTGWGRLSAKLLIGIRDKESHLTILDYLMNDDKHNRNLMQLINDSNLSFKSIIEKEQVSTADKDIQSIVADLAGSPAIKKGILQSLKIVDELVGIMGYPPQTIVVEMARENQTTGKGKNNSKPRFTSLEKAIKELGSQILKEHPTDNQGLKNDRLYLYYLQNGKDMYTGQELDIHNLSNYDIDHVVPQSFITDNSIDNRVLASSAANREKGDNVPSLEVVRKRKVYWEKLYQAKLMSKRKFDYLTKAERGGLTEADKARFIHRQLVETRQITKNVANILHQRFNCKKDESGNVIEQVRIVTLKAALVSQFRKQFQLYKVREVNDYHHAHDAYLNCVVANTLLKVYPQLEPEFVYGDYHQFDWFKANKATAKKQFYTNIMLFFAKKDRIIDENGEILWDKKYLDTIKKVLNYRQMNIVKKTEIQKGEFSNATANPKGNSSKLIPRKADWDPIKYGGFDGSNMAYAIVIEHEKRKKKTVIKKELIQINIMERTAFEKDQKEFLEGKGYRNPKVITKIPKYTLYECENGRRRMLGSANEAQKGNQMVLPNHLMTLLYHAKNCEASDGKSLAYIESHREMFAELLDSISEFASRYTLADANLEKINTIFEQNKSGDVKVIAQSFVNLLEFNAMGAPASFKYFETNIERKRYNNLKELLNATIIYQSITGLYEARKRLDD

SEQ ID NO: 181 - protein, 1082 aa, Neisseria lactamica
MAAFKPNPMNYILGLDIGIASVGWAMVEIDKEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFSNPHVSDSLKEGIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEAPTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDNPAKAFAEPFYKYDKAGNRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKNQIDELGKEIRPCRLKKRPPVR

SEQ ID NO: 182 - protein, 1326 aa, Streptococcus pseudoporcinus
MLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 183 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 184 - protein, 1150 aa, Enterococcus faecalis
MYSIGLDLGVSSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGINDVAKLLGVKKERLSGWRLDKKGKPEIHTLKGYRNWRKIFAESGIDLATLPTETIDCLAKVLTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKNNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQCYDVRFYNFQSANSINFKGLEQEMMPAENQFKQKPYNNGAINLNIAKYGKEGKKLRKFNTDILGKKHYLYYEKEPKNIIK

SEQ ID NO: 185 - protein, 1345 aa, Streptococcus anginosus
MDQKYSIGLDIGTNSVGWAVVTDDYKVPAKKMKVLGNTDKQSIKKNLLGALLFDSGETAEATRLKRTARRRYTRRRNRLRYLQEIFAEEMNKVDENFFQRLDDSFLVDEDKRGERHPIFGNIAAEVKYHDDFPTIYHLRKHLADISQKADLRLVYLALAHMIKFRGHFLIEGQLKAENTNVQALFKDFVEVYDKTVEESHLSEMTVDALSILTEKVSKSRRLENLIAHYPAEKKNTLFGNLIALSLGLQPNFKTNFQLSEDAKLQFSKDTYEEDLEGLLGEIGDEYADLFASAKNLYDAILLSGILTVDDNSTKAPLSASMVKRYEEHQKDLKKLKDFIKVNAPDQYNAIFKDKNKKGYAGYIENGVKQDEFYKYLKGILLQINGSGDFLDKIDREDFLRKQRTFDNGSIPHQIHLQEMHAILRRQEEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPANIIIEMARENQMTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWNPKKYGGFDSPVVAYSILVFADVEKGKSKKLRKVQDMVGITIMEKKRFEKHPVDFLEQRGYRNVRLEKIIKLPKYSLFELENKRRRLLASARELQKGNELVIPQRFTTLLYHSYQIEKNYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 186 - protein, 849 aa, Listeria ivanovii
  misc_feature (780)..(780): Xaa can be any naturally occurring amino acid
LIDKNGTPQHITMIDKMRGKCTYFPEEVRIAKMSYTAELFGLLNDFNNIYFADPETGEKIGFTEADKKYFIDTFIHDQKGVKNITLKQIMKHKNIINETDIFGYRINTKNGTPIFTEFKGLKALKKALKEVDLPDEFYQNTEMMDEIANILSSEKSFTRREEQLKELFLAAFNDELEEAVKELINDITFKEFHSLSKKAIMVILPELWSTNQNQMQLFVQHKMDKSRLENLQNGTKIQFDDEAILSTIAKRAHRETIKIVDAVRAKYGELDYVIVEMAREKNSDEQKKVYNRAQKKQGDFEKEMCKLLGVSELKELRLNGKQHLALKFWKEQDGKCIYSGKPIALSDIVNNFNGLLEIDHIIPISISYDDSQQNKVLCLRSENQRKGQLSPYQYLIRGMGERSFDAFKAEVLSRHFGKKKQNYLLEMEDIANNDELRKHFINRNLVDTRYAMRTFSNTLKTFYTVNGIPTKVMPVNGAMTSALRKRAKLNKDRDAGHAHHAIDALIVAAIGRLPLIKQLAELRVNEEGEFADKITDKGLDDKTAFDDKTLKFLRNLLNYESKVKYSHKVDRKPNRSLSKQTLYSTREKDGEKYIIGKVKNIYTLDKAGYAALKKRIDKNPEDFLMAQHNPKTWEEIIKIMEVYSKADNPFKEFYDEHGFIMKDGKVPVKSLRYHDKKLGIHVPLTHKYENTRHDVVLLKRNSLRVDIYMNKEGVYKYQGVPYNWFNQKGDKYILDMEKYHNEIDGTRASFKNIDNTFEFQFSLYKNDVFSYMKKDKEGEXVSYTKLFRSDSSPRENRLEVENIDMRTSSQQMPTINPLKNLIKYNTDILGNTYPIQKEKFVTVFTLHSK

SEQ ID NO: 187 - protein, 1457 aa, Prevotella buccae
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGATLKTDKEGYVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQHWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIAEMNQNISKYNDGKPHQPILKVRITEPMGAKYRVGQTGNKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGNECHFIPYYVANVIYNKGGFNMQMHRPQS

SEQ ID NO: 188 - protein, 1330 aa, Enterococcus italicus
MKNDYTIGLDIGTNSVGYSVVTDDYKVISKKMNVFGNTEKKSIKKNFWGVRLFESGQTAQEARMKRTSRRRIARRKNRICYLQEIFQPEMNHLDNNFFYRLNESFLVADDAKYDKHPIFGTLDEEIHFHEQFPTIYHLRKYLADGDEKADLRLVYLAIAHIIKFRGNFLIEGELNTENNSVIELSKVFVQLYNQTLSELEGFQFIDESIDFSEVLTQQLSKSERADNVLKLFPDEKGTGIFAQFIKLIVGNQGNFKKVFQLEEDQKLQLSTDDYEENIENLLAIIGDEYGDIFVAAQNLYQAILLAGILTSTEKTRAKLSASMIQRYEEHAKDLKLLKRFVKEHIPDKYAEIFNDATKNGYAGYIDGKTKEEEFYKYLKTTLVQKSGYQYFIEKIEQENFLRKQRIYDNGVIPHQVHAEELRAILRKQEKYYSFLKENHEKIEQIFKVRIPYYVGPLAKHNEQSRFAWNIRKSDEPIRPWNMNDVVDENASAVAFIERMTIKDIYLNENVLPRHSLIYEKFTVFNELTKVLYADDRGVFQRFSAEEKEDIFEKLFKSERKVTKKKLENYLRIELSISSPSVKGIEEQFNANFGTYLDLKKFDELHPYLDDEKYQDTLEEVIKVLTVFEDRSMIQNQLEQLPLNLSTKTIKALSRRKYTGWGRLSARLIDGIHDKNSGKTILDYLIEDESDSYIVNRNFMQLINDDHLSFKKIIEDSQPYKEQQSAEEIVSELSGSPAIKKGILQSLKIVDELVAIMGYKPKNIVVEMARENQTTGRGKQNSKPRLKGIENGLKEFSDSVLKGSSIDNKQLQNDRLYLYYLQNGKDMYTGHELDIDHLSTYDIDHIIPQSFLTDNSIDNRVLTTSKSNRGKSDNVPSEEVVRKMDRFWRKLLNAKLISERKYTNLTKKELTESDKAGFLKRQLVETRQITKHVATILDSKFNEDSNNRDVQIITLKSALVSEFRKTFNLYKVREINDLHHAHDAYLNAVVALSLLRVYPQLKPEFVYGEYGKNSIHDQNKATIKKQFYSNITRYFASKDYIINDDGEILWNKQETIAQVIKTLGMHQVNVVKKVEIQKGGFSKESIQPKGESQKLIRRKQQWNTKKYGGFDSPVVAYAILLSFDKGKRKARSFKIVGITIQDRESFEGNPILYLSKKDYHNPKVEAILPKYSLFEFENGRRRMVASASETQKGNQLIIPGHLMELLYHSKKIINGKNSDSVSYIQNNKEKFREIFEYIVDFSSKYISADANLNKIEKIFENNFHKASEQEIAKSFINLLTFTAMGAPADFEFFGEKIPRKRYVSISEIIDAVFIHQSITGLYETRVRLTEV

SEQ ID NO: 189 - protein, 1123 aa, Mobiluncus curtisii
MFVYLNSPRGFGPATFLTDLPHFCIIFGNNDFMDNRKYHVGIDVGTNSVGFAAVEVGDSGSPIRFLNTMVVIHDSGVDPEQKKYAITRLASAGTARRTRRLYRTRRQRLRELDDFISNELGYPLVNLENFADPYEPWKVRADLATIKLPADELPEAMSIALRHMARHRGWRSPYQRVEALHLHAEISEEFSALKKRVMEKTGDVFSDDATPAEVLVDLMGRQKIRGADGMLSGKLRQSDNANELRKIASVQGIDDETLNRIIDRVFFSRSPKGKASERVGMDALPGQGSKPRALKAMPSFQKFRIVSVICNLRIKDSGDDNRPLSMEEKEQLIGYLMSSTTDDHVTWTDVAELLHVKRSNLQGTAKEGPDGERPYTRPPVNSAWSKIKDSKIKSLVALWKTGDVDVQSAIVEALSNASVLEDARPGADIVVAYLESLDDKELESLDKVGLPAGRASYSEDSLERLTERMLQDDCDLFEARKREFGVSDDWKPPADPIYAPVGNPGVDRVLKIVNRLLMAAEREWGAPTQINIEHVRSGFSSELMQREFERENERRRAQNEEAVKAILTEKGGNSHVSKYDIIRYYAVKRQNCQCLYCGTPITFSDCELDHIVPRKGVGSTNSRVNLAAACRSCNRDKSNLPFAVWAGKTSNFDVSIDGAVSRVKQWQRSQNEGAREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETAREHFAVWKSNMERLTDLFNDKLENDAIPVVQPLRLRLSDSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKIFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILSGQGWRPAINVLFSKGKPRIVRRNSLGIERPSSNNGLPFSWEA

SEQ ID NO: 190 - protein, 1054 aa, Staphylococcus lugdunensis
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 191 - protein, 586 aa, Pseudoramibacter alactolyticus
MTYYLGLDMGTGSVGWAATDKNYKLIRAKGKDLWGVRLFQTAKTAAERRSHRVARLRRQREKVRIGYLKTIFSDAINKVDPGFFQRLDDSFFYAEDKNINQPYALFADTGYTDVDYYRDYPTIFHLRSTLIHDTSPKDVRLVYLAVLNMFKHRGHFLASNLSENGVDDFGDIYQQWCKSVPKPVQISDPEAKTEKIENILSKAGISNTRRLEALLEVFGIKRRDAFAEVLKLWCGLKGNLSKIWSETDFSDLDNTKPALSFKDSNLDMVLSQLEEILPDEDYSWLMLTKQIYDWSLLSGMMKDASGKSYDYLSDARVASYQKHSEDLKTLKRFYHDNHLSAAYDQMFRVMGKDNYSAYAGSVQSKKEVVRRGASCGIEELYKRIKKDLKPVPDCETKQIILENIERGTFLPKQLTRDNGVIPNQIHVHELKAILKNAENYLPFLKEGSELTNSEKILQLFQFQIPYYVGPLYSDENNYAWVVRKEGGRVFPWNFAEKVDEKASAEGFISELVARCTYLDNEKVLPKASLLYEKFMVLNELNNLRINGERISVDIKQELYQNLFTRGKKVTLKKSEGLFGGQRIFCL

SEQ ID NO: 192 - protein, 1385 aa, Gemella morbillorum
MKNKTWYLGLGVGPTSIGWAATDSNYKLLRKNKKRLWGVRLFEEAKTAVDRRTFRAERRRLARRKWRISLLEELFAKEVSKNDPNFFLRLKESKYHFEDKSLMNEYILFNDKDYTDKDYYKEYPTIYHLRLSLTTEENPDIRKVYLAVHSMLKNRGHFLLQGQSFNDSNIDSVIKELLELETVKINFEVTDEVIHSLKKIALEKKNLSDKNNDVKKLYPKEKQLQEIFKLVFGGKTSLDKLYDIEEYKELDNSVKSISFKEKVYEEVRPDYEQILSNYIELLDLAKLVYDSIVLADIKKEGKTISESKVELYNKHKDDLANLKKLVKIDSKLSEDKKKEVYFTIFKEDKEKGTNYVNYTHRSQEGKSCSYEDFKKFLKKELEKLEDSPTKTTILEELDLETFLPLQRTKDNSVVPYQIHKEELVKILDNAAKYHSFLAEKDDSGYSTREKVVQLFEFRIPYYIGPLNAHHNTENGGYSWAIRKKGMESVPVTPWNFKDVIDESASAEAFVNNLKNKCAYLSGEDVLPKNSLLYSEYALLNELNALRYEGNRISVEARDVIVTKLFKEQGKKVTKKTIKELLKTEGFIDGKGEIVGIDNIVKNDLKSYRDFKKILADKFDKERVENIILWITLYGESRKLIKEKITKVYGDFYTVDEIEKMSRLTYKDWGILSRKLLTELVSEKLYNEETGECLNIIGAMRQGTILFMELLADKFDYMSQIKNHNKENKDDITEITPDILENLHASPAVKRSIWQTVRIVEELKTIIGCVPTKIFIETTKRNNAPYKVPTLNRNDLVTKYKTIREHEIFELEKELKNTLDFTLNKNRLINEEPSKLKATKLYLYYTQLGRCMYTGKKIDLGELFDNNNKYDIDHIYPQSKVKDGSFNNIVLVTKASNDMKADVFPLKSKFQTKENKIFWRFLKEKKLITEEKYNRLVRTEEFSNGELTGFITRQLVETSQAIKVISNVLRELNPETTICYSKAENVSSFRQSFGKIKEANRKAENNEKLIRVQEINDYYNAKDAYLSIVVGNVYDVKFTRNVHNFIKNNKDARRYSLNGLFYTDVKNANTIAWEMDKTVHVVEKTMNNNNILITRRTSEQKGALYDATLYKAKVAEKAKEGTYYPLKTTDSKIKDVGKYGGFTKIKIAYYSIFEYTLDGKKGKQKITRIVPIPIYISQNIKDDKALLEYAQTRLPGKDLKIKYRKLCIGSLVKINNFNYYIGGKTNNNFTFDSAVQVILDKDSESYIKELAKYLNWKKENKDGKLWESITEDKNIQLYDSLVKKMNTGIFIRKTPNKYTELLTLEVKNKFINIDIDEQVKLLLEILNLLTNKKFTSKLNEIGITASRGVCSFNLSNQSQFSIIEQSVTGVYEKEKLIIEKKKEGIL

SEQ ID NO: 193 - protein, 1029 aa, Alicycliphilus denitrificans
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 194 - protein, 1422 aa, Sutterella wadsworthensis
MTQSERRFSCSIGIDMGAKYTGVFYALFDREELPTNLNSKAMTLVMPETGPRYVQAQRTAVRHRLRGQKRYTLARKLAFLVVDDMIKKQEKRLTDEEWKRGREALSGLLKRRGYSRPNADGEDLTPLENVRADVFAAHPAFSTYFSEVRSLAEQWEEFTANISNVEKFLGDPNIPADKEFIEFAVAEGLIDKTEKKAYQSALSTLRANANVLTGLRQMGHKPRSEYFKAIEADLKKDSRLAKINEAFGGAERLARLLGNLSNLQLRAERWYFNAPDIMKDRGWEPDRFKKTLVRAFKFFHPAKDQNKQHLELIKQIENSEDIIETLCTLDPNRTIPPYEDQNNRRPPLDQTLLLSPEKLTRQYGEIWKTWSARLTSAEPTLAPAAEILERSTDRKSRVAVNGHEPLPTLAYQLSYALQRAFDRSKALDPYALRALAAGSKSNKLTSARTALENCIGGQNVKTFLDCARRYYREADDAKVGLWFDNADGLLERSDLHPPMKKKILPLLVANILQTDETTGQKFLDEIWRKQIKGRETVASRCARIETVRKSFGGGFNIAYNTAQYREVNKLPRNAQDKELLTIRDRVAETADFIAANLGLSDEQKRKFANPFSLAQFYTLIETEVSGFSATTLAVHLENAWRMTIKDAVINGETVRAAQCSRLPAETARPFDGLVRRLVDRQAWEIAKRVSTDIQSKVDFSNGIVDVSIFVEENKFEFSASVADLKKNKRVKDKMLSEAEKLETRWLIKNERIKKASRGTCPYTGDRLAEGGEIDHILPRSLIKDARGIVFNAEPNLIYASSRGNQLKKNQRYSLSDLKANYRNEIFKTSNIAAITAEIEDVVTKLQQTHRLKFFDLLNEHEQDCVRHALFLDDGSEARDAVLELLATQRRTRVNGTQIWMIKNLANKIREELQNWCKTTNNRLHFQAAATNVSDAKNLRLKLAQNQPDFEKPDIQPIASHSIDALCSFAVGSADAERDQNGFDYLDGKTVLGLYPQSCEVIHLQAKPQEEKSHFDSVAIFKEGIYAEQFLPIFTLNEKIWIGYETLNAKGERCGAIEVSGKQPKELLEMLAPFFNKPVGDLSAHATYRILKKPAYEFLAKAALQPLSAEEKRLAALLDALRYCTSRKSLMSLFMAANGKSLKKREDVLKPKLFQLKVELKGEKSFKLNGSLTLPVKQDWLRICDSPELADAFGKPCSADELTSKLARIWKRPVMRDLAHAPVRREFSLPAIDNPSGGFRIRRTNLFGNELYQVHAINAKKYRGFASAGSNVDWSKGILFNELQHENLTECGGRFITSADVTPMSEWRKVVAEDNLSIWIAPGTEGRRYVRVETTFIQASHWFEQSVENWAITSPLSLPASFKVDKPAEFQKAVGTELSELLGQPRSEIFIENVGNAKHIRFWYIVVSSNKKMNESYNNVSKS

SEQ ID NO: 195 - protein, 1132 aa, Nitratifractor salsuginis
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 196 - protein, 1327 aa, Solobacterium moorei
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 197 - protein, 738 aa, Treponema phagedenis
MLQELFAKEIAKIDEGFFRRLDESAFYLEDKSLKQKYSLFNDDNFTDKDYYKKFPTIHHLIKALINDETHVDIRLLYLACHTIIKNRGHFLFEGKEFNTESRFDDAINELFSYLRQDMEIDFAFEDKIADIKEILENKKIGMRDKQNALNKKLSIAPKDKQKKEIIKLIVGASFNLKTLFNDEKYSSEKESYSFAKSNYEEKEAVLESLLGDGFGLILRAKAVYDSSVLSEILGNETYLSFAKVKIYDKHKEDLAKLKKVIKTYHADEFKKVFAEANIQGNYCSYVGSCKKNGKKVPIEKRADKDAFYDFLKKILKDEKAKNSDADYAFILNEIELKTFLPKQVSKKNANIPYQLRRMELEKIVNNAEKYFSFLSEKDEYGTVKEKIIQLLTFKRPYYIGIIQDTHKEKFPDRCWVVKKENAKNEKITPWNFYDHIDEDKTAEAFITSRTNKCTYLIGEDVLPRNSLLYMEYTVLNELNNLKVSVDGVNIFDVKLKKKIYEQVFKQRKEVSKKTIADFLKKEGICKKENDVVITGIDEKCTTSLKLYIDIKKIIGKRIEEEPTKNALEDIILWASIYDEGEGRKILEAKIQSVYPDVFTQDELNKILKLKISGWGRFSRKFLESIVASFPGFTDTINIITAMRETNFNLMELLGDAYGFSKGIEKFNSKFNDDKKVFSYDKLVKDLYLSPSVKRMLWRALVIVKEVKSIMGKDPKKYLLKWQEEKKLKREGLPPAMQV

SEQ ID NO: 198 - protein, 1377 aa, Streptococcus equinus
MEKTYSIGLDIGTNSVGWAVITDDYKVPAKKMKVLGNTDKKYIKKNLLGALLFDSGETAEATRLKRAARRRYTRRKNRLRYLQEIFAKEMAKVDESFFQRLEESFLTDDDKTFDSHPIFGNKAEEDTYHQEFPTIYHLRKHLADSPEKVDLRLVYLALAHMIKFRGHFLIEGQLNAENTDVQKIFADFVGVYDRTFDDSHLSEITVDAASILTEKISKSRRLENLIKQYPTEKKNTLFGNLVALALGLQPNFKTNFKLSEDAKLQFSKDTYDEDLEELLGKIGDDYADLFTAAKNLYDAILLSGILTVDDNSTKAPLSASMIKRYEEHHEDLEKLKTFIKVNNFDKYHEIFKDKSKNGYAGYIENGVKQDIFYKHLKSIISEKNGGQYFLDKIEREDFLRKQRTFDNGSIPYQIHLQEMRTILRRQGEYYPFLKENQAKIEKILTFRIPYYVGPLARKNSRFAWAKYHSDEPITPWNFDEVVDKEKSAEKFITRMTLNDLYLPEEKVLPKHSYVYETFAVYNELTKIKYVNEQGKSFFFDANMKQEIFDHVFKENRKVTKAKLLSYLNNEFEEFRINDLIGLDKDSKSFNASLGTYHDLKKILDKSFLDDKTNEQIIEDIVLTLTLFEDRDMIHERLQKYSDIFTSQQLKKLERRHYTGWGRLSYKLINGIRNKENNKTILDFLIDDGDANRNFMQLINDDSLSFKTTIQEAQVVGDVDDIEAVVHDLPGSPAIKKGILQSVKIVDELVKVMGHNPQNIVIEMARENQITGYGRNRSNQRLKRLQDSLKEFGSDILSKKKPSYVDSKVENSHLQNDRLFLYYIQNGKDMYTGEELDIDHLSDYDIDHIIPQAFIKDNSIDNRVLTSSAKNRGKSDDVPSIEIVRNRKSYWYKLYKSGLISKRKFDNLTKAERGGLTETDKAGFIKRQLVETRQITKHVAQILDARFNTKCDENDKVIRDVKVITLKSSLVSQFRKEFKFYKVREINDYHHAHDAYLNAVVGTALLKKYPKLAPEFVYGEYKKYDVRKLVAKSSDNHSELGKATAKYFFYSNLMNFFKTEVKYADGRVFERPDIETNADGEVVWNKQRDFNIVRKVLSYPQVNIVKKVEVQTGGFSKESILPKGDSDKLIPRKTKKLQWETQKYGGFDSPTVAYSVLVVADVEKGKTRKLKTVKELVGISIMERSSFEENPVSFLEKKGYHNVQEDKLIKLPKYSLFEFEGGRRRLLASATELQKGNEVVLPQYMVNLLYHSQHVNNSHKPEHLNYVKQHKDEFKDIFNLIISIARINILKPKVVDNLINEFTEYGQEDISSLSESFINLLKFISFGAPGAFKFLKLDVKQSNLRYKSTTEALSATLIHQSVTGLYETRIDLSKLGEE

SEQ ID NO: 199 - protein, 1128 aa, Streptococcus vestibularis
MSDLVLGLDIGIGSVGVGILNKVTGEIIHKNSRIFPAAQAENNVERRTNRQGRRLTRRKKHRRVRLNHLFEESGLITDFTKVSINLNPYQLRVKGLIDELSNEELFIALKNMVKHRGISYLDDASDDGNSSVGDYAQIVKENSKQLETKTPGQIQLERYQKYGQLRGDFTVEEDGKKHRLINVFPTSAYRSEALRILQTQKEFNPQITDEFINRYLEILTGKRKYYHGPGNEKSRTDYGRYTTKKDSENEYITLDNIFGILIGKCTFYPEEYRAAKASYTAQEFNLLNDLNNLTVPTETKKLSEEQKNQIINYVKNEKAMGPAKLFKYIAKLLSCDVADIKGYRIDKSDKAEIHTFEAYRKMKTLETIDFEKMSRDQLDKLAYVLTLNTEREGIQEALDHEFADGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGRAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKSLSNKKKEYLLTEEDISRFDVRKKFIERNLVDTRYASRVVLNALQEHFRAHKTDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRQAKVGKDKKDETYVLGKIKDIYSQTGYDAFIKIYQKDKSKFLMYRHDPQTFEKVIEPILENYPNKEMNEKGKEVPCNPFLKYKEEHGDYIRKYSKKGNGPEIKSLKYYDSKLGNHIDITPKDSNNKVVLQSVSPWRADVYFNKTTGKYEILGLKYADLQFEKGTGTYKISQEKYNVIKKKEGVDSDSEFKFTLYKNDLLLIKDTETKEQQLFRFLSRTKPNVKHYVELKPYDKQKFEGNESLINVLGAVAKGGQCQKGINKPNISIYKVRTDVLGNQHIIKNEGDKPKLDF

SEQ ID NO: 200 - protein, 1080 aa, Methylocystis sp.
MRVLGLDGGIASIGWALIEIFEDHEPSDGRIIDTGAWMFDAPEEKSQTGTKLKSELRRIFRGQRRVIRRRRQRMNEVRRILHRHGLLSSDNRDALKQPGLDPWKIRAEGIDRLLSPIEFAVALGHIARHRGFKSNSKGAKTSDLDAESSRMKKAVGETREKLARFGSPAKLLVEDEGFVLRQTKLKSGALETVRRFRNRDGDYSRSLLRDDLAAEVRALFRAQARLQSTFAKVELEAEFTQAAFFQRPLQDSERLVGPCPFEPAEKRSPKRGYSFELFRFLSRLNHLTLREGSEERTLTVEELRTAAADFGGVAKFTFSTLRKRLALPDIAIFVGIKADDEKKLDVVARSGEAATGTARLRRVVIDALGELAWGALISAPERLDKITEIITFRSDLDRIRAGLIEAGFDTPLIEAIVRAAADGKLDAFTGVGHISAKAARNIIPGLMRGMTYDKACAAAGYDHTASRERDAFDVGMHGKEALKKILQEERISRELVGSPSARKALIEAVKQVKAIIEKYGVPDRIHVELARDVGKSIEERRDIHFGIEKRSRQKDKLRELFGKEVGHLPQDGERGKEELLRFELWNEQMGRCLYTDEYINPKQLVASDNSVQVDHILPWSRFGDDSYLNKTLCTAKANQDKKGRTPYEWFRADKPEAEWDAFVARVESIQFMKGLKKRNYKLKNAEEAAEKFRSRNLNDTRWTCRLLAEALKQLYPKGEKDKDGKERRRVFTRPGALTNRLRRAWSLQRRKKSEKGERIADDRHHALDAIIVAATTESLLIRATREVQDIERKGLHYDLTKNITQPWPGFADEALDAVEKVFVARAERRRARGKAHDATIRHIAVRDDEAKVYERKKVGDIKLGDLIRVKDAERNAPLIENLRKWIEAGSPRDNPPLSPKGDPVSKVRLVTKNKVNITLDTGNPERLATVDRGEMARVDVFRKANRKGKYEYYLVPIYPHEIATMETPPMRAVQGGGDDDKWPEIDSTFEFLWSINQLSLLELTKPDGEVIRSYFRSLDRNTGALTVSGIANSTATRKGIGTRTLIDFKKLHVDRLGQIFEVERELRTWRGETWRGKDCI

SEQ ID NO: 201 - protein, 1087 aa, Phascolarctobacterium succinatutens
MLRMKYAIGLDIGIASVGYAVLALDHEENPWGIIRLGSRIFDVAENPKDGASLALPRREARSVRRRLRRHHHRLERIKNLLINTEFITKDELLHLYDGNLSDVYELRVKALDYSVTNAELTRILLHLAQRRGFKSNRKSDANDKEAGQLLEAVSANAKRMQENHYRTVGEMFYKDDLFSKYKRNKGGTYLTTVHRDMIAAEARTILEKQFALGNNICTQDFIDKYLSILLSQRQFDEGPGEPSPYAGNQIANMIGKCTFEPNEYRAAKASYSFERFNLLQKVNHLRLLLEGKSIALDNEQRKKIIALAHDKADLRYSHIRKALGLDEKVLFNTITYNDDVSVIEKKTKFNFLQAYHQIKKVLAEDMQKLTTEQLDNIGQILSTYKSDNKRTEELSALGLEKKIIDALLGINGLSKFAHLSLKALRKINPYLEEGKIYNEACTAAGYDFKAHANTQKTELLPAYKEEMDDITSPVARRAIAQSIKVINAIIREQKGSPLYINIELAREMAKGFDERTQIDKANKENQAKNERIMERIRTEFHKANPTGMDLIKLKLWEEQDGRSPYSQKAISINRLFEPGYVDIDHIVPYSISFDDSFKNKVLVFSDENRDKGNRLPIAYLQSKFGAKAAENFMIWVQSNIKDYKKRQKLLKREITEEDINKFKERNLQDTKTISRFLYNYINDYLLFAPSDTGKKKRVTAVNGTITAYLRKRWGINKIRANGDKHHAVDAVVIACTTDKMIKDLSSFSRYHELEYTHTDTESFLVNSLTGEILKRFPYPWEDFRPELMARLSDNPADALRKLNLIFYHGIDLSTIKPIFVSRMPRHKVTGAAHKATIKSARCLDNGIVICKTSLQNLKLDKEGEIANYYAPESDTILYNALKERLRSYDNKPAKAFAEPFYKPKADGTPGPLVKKVKVYEKSTLNVAVQQNTAVADNDSMVRVDVFHVKGNGYYLVPIYIADTLKKELPNKAIVAYKPYADWPVMDDSNFIFSLYPNDLIKFEHKNSVKFAKVNKESTLNDFYSTKSEIVYFKGCNINTGAITIINHENTYVVSSLGVKTLPSLEKYQADVLGNYTKVKKEVRKPFR

SEQ ID NO: 202 - protein, 1375 aa, Lactobacillus ruminis
MRKNQEPYNIGLDIGTSSIGWSIMNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 203 - protein, 1391 aa, Prevotella oralis
MKKILGLDLGTTSIGWALVNEKENNEELSSIIRLGVRVNPLTVDEKSNFEKGKDITTNADRTKCRSARRNLQRFKLRREALADCLKRHGLMTDETPLCETNNSIIFKTYSNRAKAVCEKIALDDFVRVLFMINKKRGYKSSRKLNTDDEGTLVDGMDVAKLLYNEQITPGEYLLRLFKKGKKTRPDFYLSDLKAELERIWDFQRTFYPEILCNALKEDLKGKSRTQSSAIFYAKYKVSTAKIAGKDKRLQELTWRTDALRKQLTIDEVAYVICSINGEVNGSSQRLSMISDRSKLLYFNHQTIGQYLMQRLEENPNAGLKNIIFYRQDYEDEFNDIWNSQATYHKELTPELKKEVKDIIFYQRGLKSCKWLINYCELEHEEIEVKTPEGKLRKITIGSKTCPKSSPLFQEFKIWQVLNNLQVSPLNSRRKAKRKKDEEPSLFSDEDMNTACRYLNEEEKLTLFKELSIKKELKKKDALKLLFENYKELDLNYKVISGNVTMANLYRAFQDIISLTGNGEFDFQAMPAEEAEKTVEEIFGGLGYKTAFLHFDASLHDKEFERQPAYRLWHLLYSYAGDQSKTGIEALVKRIQELCGFEPEYARILANISFIPDYGNLSSKAMRKILPYMQDGYEYSEACSKAGYRHSASSLTKEEINKKNYKTHLDEIKRNSLRNPIVEKILNQMVNVVNSVIDTYSNIDEIRIEMARELKKSKPEREDMSFAISKATKETERIKGILEQEFKIQHVTRNDIIRYRLYEELKPNGYKTLYSNTYIPREDLFSKKFDIEHIIPKARLFDDSYSNKTLELRDINIEKGNQTAYDFVLSKYGEEGLYKYEQRVEEFKKNNEQAGTKCRKLLMREADIPSDFLNRDLNDSQYIAKKAHELLREIVPTVTATTGSITNRLREDWKLVNVMKELNWEKYDKLGLTEEYKDKDGNTVRHIKDWTKRNDHRHHAMDALTIAFTKPSFIQYLNNLNARSNRGGSIYGIEQKELERENNKLVFIPPIDPKIFRKQAKEHLSNILISIKAKNKVVTKNVNKTKSKSGTNRKVQLTPRGQLHLETVYGKIRTYKTEEIKVGTKLTEELIAKVADKKIREALMQRLSEYGGNIKKAFQNISKHPIWLNGSHTKHVPEKVKIVFFEDVFTIRKAITPDIKIDKVIDSKIRRILQERLNEFGGEASKAFSNLDENPIWFNRDKGIAIKSVKIRGIAKGTAIRVKKDIHGKTIIGNNGYPVANDYVNTGNNHHVAIFRDKDGNLQEHIVSFYEATARAIQNLPIVDRNYNSEKDWKFLFSMKQNEYFVFPNPNTGFNPSEISLKDEKNYALISPNLFRVQKLSHYYYVFRHHLETNVDTNLQLKDITWKRITAVNNLTGAVKVRIDHLGRIVDVGEYK

SEQ ID NO: 204 - protein, 1167 aa, Streptococcus sanguinis
MLFGLKTKFKDCFELEEEPDLNFSKENYDDNLEKLLGELGEDFSDVFDKLKILRDTILLSGMLTYTGATHARFSATMVERYEEHRKDLQRFKSFIKQNLSEQDYLDIFGRKTQNGFDVDKETKGYVGYITNKMVLTNPQKQKTIQQNFYDYISGKITGIEGSEYFLNKISDRTFLRKLRTSDNGAIPNQIHAYELEKIIERQGKDYPFLLENKDKLLSILTFKIPYYVGPLAKGNNSRFAWIKRANSSDILDDNDEDTRNGKIRPWNYHKLINMDETRDAFITNLIGNDTILLNEKVLPKRSLIYEEVMLQNELTRVKYKDKYGKAHFFDSEHRQNIINGLFKINSKRVNAERLIKYLSDNHKDLNAIEIVSGVEKGKSFNSTLKTYNDFKTIFSEEFLDSEIYQKELEEIIKVITVFDDKKSIKNYLTKYFGHLEFLDEEKINQLSKLRYTGWGRYSAKLLLDIRDEDTGFNLLQFLRNDEENRNLTNLISDNTLSFDPKIKAIQSKSTVEDDVFDEIKKLAGSPAIKRGILNSIKIVDELVQIIGYPPQNIVIEMARENMTTEEGQKKTKTRKSKLESALKNIENSVLENGKVLHSDEQLQSEKLYLYYLQNGKDIYSLDETGSPAPIYLDQLDQYEVDHIIPYSFLPIDSIDNKVLTHRKNNQRKLDNIPDKETVAHMKPFWEALYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHVHFNRHEENKATLRKHLYSNIMRFFNNPDSKVSKDIWDCNRDLPIIKHVIYNSQINFVKRTMIKKGAFYNQNPVGKFNKQLAANNRYPLKTKALCLDTSIYGGYGPMNSTLSIIIIAERFNEKKGKIETVKEFHDIFIIDYEKFNNNPFQFLNDTSENGFLKKNNINRVLGFYRIPKYSLMQKIDGTRMLFESKLNLHKATQFKLTKTQNELFFHMKRLLTNSNLMDLKSESAIKESQNFILKHKEEFDNISNQLSAFSQKMLGNTTSLKNLIKGYNERKIKEIDIREETIKYFYDNFIKMFSFVKSGAPKDINDFFDNKYTVARMRPKPDKRLLNATLIHQSITGLYETRIDLSKLGED

SEQ ID NO: 205 - protein, 1334 aa, Staphylococcus pseudintermedius
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 206 - protein, 1156 aa, Ruminococcus albus
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 207 - protein, 1440 aa, Weeksella virosa
MKTILGLDLGTNSIGWALVEQDFENKQGLILGMGSRIIPMDAGIIGKFAEGSSISQTAERTGYRSIRRLRERHLLRRERLHRVLNILKFLPEHYAAEIDFEKRFGQFLAETEPKLAWKKNAEGKFEFLFQRSFDEMVADFKANGQDIKIPYDWTIYYLRKKALTQKISPQELAWIILNFNQKRGYYQLRGEEEEENPNKKVEFYSLKIVDVVADEQPNKKGDTWYSLHLENGWVYRRSSKIPLYDWKDKVRDFIVTTDINEDGSEKLDKDGEVKRSFRAPKEDDWTLIKKKTEQEIEQFNQTVGSYIYEALLDNPTQKIRGKLVRTIERKFYKSELKKILEKQIELQPELFTEDLYNACARELYRRNVAHQQQLSSRDFVYLFLNDIIFYQRPLRSQKSLISNCSLEFRTIKDKDGNGQIIYLKAIPKSNPYYQEFRVWQWLYNLKIFTKEDDKDVTNQFINKVEDLEALFEFLMNQKEVNHTDILTYLIEPIVKSKYPNAKGKAFKDELKKELKKYRWNYVYDADKDESKSYPMNETRYELRKRLDKVENVPADFMTRKIEQHLWHIIYSVTDKIEFEKALKSFANKYDLHQESFVENFKRFKPFDSDYGTYSEKAIKKLLPLMRVGKYWSWDIIDDKTKTRIGKIITGEYDETIKNRVREKAIDLTEENHFQGLQLWLAQYIVYDRHSEADIAGKWNSVADLEQYLSEFKQHSLRNPIVEQVITETLRVVRDIWKQYGKGAKDYFDEIHIELGREMKNTAEERKRLSSIISENETTNLRIRAILEELMYDENMENVRPYSPMQQEALKIYEDGVLSSSVEIPEDIEKISKKSEPTKSEIQRYKLWLEQKYRSPYTGRPIPLSKLFTPAYQIEHIIPQARFFDDGFSNKVICESEVNALKDKMLGLEFIQNYYGQKVTTSFGEVTILTEDAYKAFVKEHYDKNRSKRNKLLLEEIPEKMIDRQMNDTRYISKYISKVLSNLVRGEKDDEGVNSKNIIPGNGKITGILKQDWGLNDVWNDLILPRFERMNQLTNSTDFTAWNEKHQKFLPSVPLELSKGFQKKRIDHRHHALDALIIACATRDHVNLLNNKHAKSRNERYDLQHKLRHTTPWQDKEGKVRTKFTEFKKPWETFTQDTKKELEKIVVNFKQNLRVINKATNYYEKIVDGKKVMFKQEGVNWAIRKPMHKETVSGKIDLPRVKVSKGKILTATRKSLDTSFNAKTILSITDTGIQKILLNYLKAKGNPELAFSPEGIEEMNQNISLYNDGKPHQPILKVRVFEQGSKFPLGETGNKTTKYVEAAKGTNLFFGVYEDNQGKRSYDTIPLNIVIERQKQGLNSVPETNEKGHRLLFSLSPNDLVYVPIEGEVFDETNPDVNRIYKVVSFSGSQMFCVRQDVATSIVYKLEFSSLNKMERTIDGIMIKEICIKLKVDRLGNISKA

SEQ ID NO: 208 - protein, 1179 aa, Sphaerochaeta globus
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 209 - protein, 1370 aa, Streptococcus gallolyticus
MTKKNYSIGLDIGTNSVGWAVITDDYKVPAKKMKVLGNTDKKYIKKNLLGALLFDSGETAEATRLKRTARRRYTRRKNRLRYLQEIFAEEMTKVDESFFYRLDESFLTTDEKDFERHPIFGNKAEEDAYHQKFPTIYHLRNYLADSSEKADLRLVYLALAHMIKYRGHFLIEGKLNAENTDVQKLFTDFVGVYDRTFDDSHLSEITVDVASTLTEKISKSRRLENLIKYYPTEKKNTLFGNLIALALGLQPNFKMNFKLSEDAKLQFSKDTYEEDLEELLGKIGDDYADLFTSAKNLYDAILLSGILTVDDNSTKAPLSASMIKRYVEHHEDLEKLKEFIKANKSELYHDIFKDKNKNGYAGYIENGVKQDEFYKYLKNTLSKIDGSDYFLDKIEREDFLRKQRTFDNGSIPHQIHLQEMHAILRRQGDYYPFLKEKQDRIEKILTFRIPYYVGPLVRKDSRFAWAEYRSDEKITPWNFDKVIDKEKSAEKFITRMTLNDLYLPEEKVLPKHSHVYETYAVYNELTKIKYVNEQGKESFFDSNMKQEIFDHVFKENRKVTKEKLLNYLNKEFPEYRIKDLIGLDKENKSFNASLGTYHDLKKILDKAFLDDKVNEEVIEDIIKTLTLFEDKDMIHERLQKYSDIFTANQLKKLERRHYTGWGRLSYKLINGIRNKENNKTILDYLIDDGSANRNFMQLINDDTLPFKQIIQKSQVVGDVDDIEAVVHDLPGSPAIKKGILQSVKIVDELVKVMGDNPDNIVIEMARENQTTNRGRSQSQQRLKKLQSSLKELGSNILNEEKPSYIEDKVENSHLQNDQLFLYYIQNGKDMYTGDELDIDHLSDYDIDHIIPQAFIKDDSIDNRVLTSSAKNRGKSDDVPSLDIVRARKAEWVRLYKSGLISKRKFDNLTKAERGGLTEADKAGFIKRQLVETRQITKHVAQILDARFNTEHDENDKVIRDVKVITLKSNLVSQFRKDFEFYKVREINDYHHAHDAYLNAVVGTALLKKYPKLASEFVYGEYKKYDIRKFITNSSDKATAKYFFYSNLMNFFKTKVKYADGTVFERPIIETNADGEIAWNKQIDFEKVRKVLSYPQVNIVKKVETQTGGFSKESILPKGDSDKLIPRKTKKVYWDTKKYGGFDSPTVAYSVFVVADVEKGKAKKLKTVKELVGISIMERSFFEENPVEFLENKGYHNIREDKLIKLPKYSLFEFEGGRRRLLASASELQKGNEMVLPGYLVELLYHAHRADNFNSTEYLNYVSEHKKEFEKVLSCVEDFANLYVDVEKNLSKIRAVADSMDNFSIEEISNSFINLLTLTALGAPADFNFLGEKIPRKRYTSTKECLTATLIHQSITGLYETRIDLSKLGEE

SEQ ID NO: 210 - protein, 1044 aa, Nitrosomonas sp.
MLHKMRYRLALDLGSTSLGWAMVRLNANQQPCAVIKAGVRIFSNGRNPKDGSSLAVTRREARSMRRRRDRLLKRKARMMRTLIEYGFFPANETQRKALENLNPYALRAKGLDEALTPSEFARALFHINQRRGFKSNRKTDKKDSDSGALKTAIKQLHSVLDPQGNDGKPRTVGELLYKRFTDLSKLPKDRTVRARYRQDKIVKDDGKTKIDKYYDLYIDRAMIEQEFDALWKKQSELNPILFTENARADLKDVLLYQRSLKPVKPGRCTFMSEEERAPLALPSTQRFRMYQEVNNLRILREGLKEESLTLQQRDDLINALEKNNRRTFTQIKKLLGVGGSVQFNFEDPKREELKGNTTSAILGKSEHFGEAWFAFNEAKQDAIVLQLIKEENEAKLVRWLQDETGIDEKRAEVIANAGLPEGYGSLCIEALARILPELRRDVVTYDKAVQAAGFEHHSKLNRNEEIPDITFKIESIDRNSGEIKQFHLHKELPYYGEYLQRHVGFGSGKPEDSIEKRYGKIANPTVHIGLNQVRVVVNALIKRYGHPSEIIVEVARDLKQSKDRRDEENKRQAENQKRNERLRKDIADILGISEERVRRDDIEKMILWEELSFDPADRRCPYSGVQVSTVMLLSDEVEVEHILPFSQTLDDSLNNKTVALRQANRIKGNRTPWEAFGTSNISGFDYSGILTRAELMPKAKRYRFAEDGYQRWLKDDAGFLARALNDTRHLSKIAREYMSLICPNTRVIPGQMTAMLRRNFGLNDVLGLNGEKNRNDHRHHAVDACVIAVTDQGLLQRFAAASASARERQLNRLVENMPLPWESYREHVRRAIDGIWVSHRPDHSHEGAMHNDTAYGLRGNGRVSFHKMVEGKREYIEDNLKVIEITDTKAIDRHGLLPTGKPRPYKGYKGDSNYCIEIVRNEKGRWEGEIISTFDAYQLVRKYGIVQLRYPVLSVSGKPLVMRLIRNDFVRLEHEGITRTLRVCKMREDGQVALADVTEANVDARTRTKEICYVFKTGGSLQKAKARRITISPIGELRDPGFKE

SEQ ID NO: 211 - protein, 1045 aa, Acidovorax avenae
MQKEKPLAYRLALDLGSTSLGWAVLRLSAPGEPSAVIRAGSRIFSDGRNPKDGSSLAVTRRAARAMRRRRDRLLKRKARMLAALERHGFFPQDEAARKALEKLNPYGLRARGLESALKPEEFGRALFHLNQRRGFQSNRKTDRKDSDSGALKQAIGTLRAQMHESGCRTVGEWFWKVRMERKPEGVKGQGVRARYRETPFTTDEGKKRIDKRYDLYVDRAMVAQEFDALWAAQATFAPALFNEAARAELRDILLHQRKLRPVQPGRCTLVPEEPRALLALPSTQRFRIYQEVNHLRVLHDELREEALTLAQRDQIVALLERQAKVTFTAMRKALGFSALFNLEDAKRDGLKGNATTAALGKKDLFGPLWAGFDTALQDEIVTQLMTEESEPRLIAWLQEHTGVDEARAQAIANAGLPEGYGSLGRTALARIVPELQRDVITYDKAVQAAGFAHHSDLGFSFEHDADEVERIGERTIASTGEIKPVFAFKQLPYYGRALQRHVAFAKENPRNDEERYGKIANPTVHIGLNQVRVVVNALMCRYGRPTEVVIELARDLKQSREQKLEAQQRQADNQKRNARIRRSIAEVLGISEERVRTLDIQKWILWEELSHDAADRRCPYSGVQISASMLLGERVEIEHILPFSMTLDDSLNNRTVALREANRIKRNRTPWDARTDFEAHGWSYDGILQRAERMPQRKRHRFAPDGYERWLGEDKDFLARALNDTRYLSRVAAEYLRLVCPGSATRVIPGQMTALLRGKFGLNDVLGLDGEKNRNDHRHHAVDACVIGVTDQRMMQRFAQANAQAREDGLTRLVEDMPLPWPTYRAHVERAVRHIWVSHKPDHGFEGAMMEETSYGILRDGTIKQRRKADGSAGREISRLIRITEPSQPQRHGVDAEGRPLPYKGYVGGSNYCLEITVNDKGKWEGQVISTFDAYRIVREGGLRQLRHSTQGQNGQALAMRLVIGDSVRLEVDEQERVMRIVKINGNNGQVFMAPVHEANVDARNSDKNEAFAYTSKIAGSFQKTKARQVTISPIGELRDPGFKG

SEQ ID NO: 212 - protein, 1218 aa, Prevotella denticola
MKASEEKLSKGLSTYMKENNLLTVGAAFAQLEDEGVRIRNNNNYRAIRSQFQHEIETIFMFQQGLSENELYERLVSEKKNIGTIFYKRPLRSQRGNVGKCTLERTKPRCAIGHPLFEKFRAWTLINNIKIRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGEQWKKLYHPSQIAIYRPVSAGKDRSALRLGNPDIGAIKNPTVLRVLNTLRKRVNQLLDDGLISPDETRVVVETARELNDANRKWALDNYNRIRHDENEKIKKILEEFYPKRDGISTDDIDKARYVIDQREMDYFTEEKPYNKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQFAKDKDGKVLLKEGHPLVDPTIKFVIRRELKYKKSTADSGFASWDDLEKAIVDKELFALMKGQFPEETSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 213 - protein, 1458 aa, Fluviicola taffensis
MTKTILGLDLGTNSIGWALINQDFDNKKGEILGMGSRIIPMTQDIKDEFGKGNSISQTAERTRLRGVRRLIHRTLLRRERLHRVLNIIGFLPEHYANQIDFEKRFGKFKPESEPKISFDGNDVFLFEKSYQEMLVDFKIHQPQLVSNGKKIPHDWTIYYLRKKALSKKIEKEELAWILLNFNQKRGYYQLRGEEEEETPNKLVEFHSLKIVEVNADEPQKGKPEIWYSLVLENGWVYRRASKTPLFDWKDKIREFIVTTEINNDGTVKTDKEGTEKRSFRAPKPEDWTLQKKKTEFELSKSGNEVGAFIYESILQKPNQKIRGKLISTIERKFYKEELKTILKTQLFFHKELKDEKLYNACIEELYKNNEAHRSLLSNKGFEHLFINDILFYQRPLRSKKSQISNCPLEKRTYKKEGIEITEGIKVISKSNPIYQEFRLWQWISNLSLYCIEPTETNVTSTFLNSIEDYENLFEFLNNRKEIEQKHLLKYLLENQGFKGKLLTNELEKFRWNFVADKKYPCNETGSLLHTRLSKVKNISPDFLTKEIEHQLWHIIYSVTDKIEYEQALKTFARKNNLDVDSFFEHFKKIPPFESTYGAYSEKAIKKLLPLIRLGKYWNWEAIDSISKDRISKILSGEYDENIKNRVREKAVHLTSENNFQGLQEWLAKYIVYDRHSEGNDLGKWTSVSDLETYLKEFKQHSLRNPIVEQVITETLRVVKDIWIKHGKGTENFFDEIHVELGREMKNNSEDRKRLTNTITENENTNLRIKALLMEMMNDNDVENVRPYSPSQQEILKIYEDGALNSNIELDDEIVKISKKAEPTKSELQRYKLWLEQKYRSPYTGQVIPLNKLFTSEYEIEHVVPQSRFFDDSFSNKVICESAVNKRKDNQLGLQFIKNHSGEKVELGFGKVVQVFTEEQYLDFVKEHYSKNRSKHNKLLLEEIPEKMIERQLNDTRYISKFVSSILSNIVRSEKDDDGLNSKNILPGNGKITTELKRDWGLNDVWNDLILPRFERMNTITNSDLFTTYNDKYQKHLPTVPFEYSKGFQKKRIDHRHHAMDALVIACATRDHLNLMNNQSAKSELKRYDLQNKLRKKEPYFNQKENKQKEAFKDFIKPWGTFTEDSKNALEKIIISFKQNLRVINKATNSYESYKDEDGNLRIGKDGKPEKGLIKQKGLNWAIRKPLHKDTVSGQINLSRIKLPNGKILTATRKNLDTSFDLKTIENSITDTGIQKILKNYLLSKESPELAFSPEGLEEMNNEIEKYNNGKFHHPINKARIYELGSKFNVGQTGNRRDKFVEAAKGTNLFFAIYQDENKNRSYETIPLNEVIEHQKWRASLPKEEQEKIPLVPVNKLKGTFIFSLSPNDLVYVPSNDELERSASIDFSKLKKEQINRLYKMVSSSGSQCFFVKSEVATSVVNKMEYSSLNKMEKSIDNLMVKEICIKLKIDRLGNISKA

SEQ ID NO: 214 - protein, 1384 aa, Coriobacterium glomerans
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 215 - protein, 1077 aa, Neisseria bacilliformis
MQQKPQRYILGLDLGIASVGWACVWADENEHPTGLLDCGVRTFERAEVPKTGDSLALARRQARSVRRLIRRRAHRLLRLRRLLKREGVLLSADFNENGLVRGLPIDAWALRVAGLDRKLSNKEWAAVLLHLVKHRGYLSQRKNETQSKDKELGRLLAGVNGNREALQNRSDEYRTAAELAVKKFAAENNGSLRNKGGDYSHTFDRKDLQRELHLLFERQRALDNPFTSSEMEAAVDELLMKQRSALQGEAVLKMLGRCTFEPSEYKAAKNTYSAERFVWLTKLNNLRIQYNGEERALSEAERRLLLDEPYQKAKLTYKQVRTILELPESAVFKGLRYGHGEDGLKAESGTLMEMKAYHAVRKALKDAGLEGEWENRIRNPELLDAIGTAFSLYKTDEDIRANLAAFRLSENVLEALLAGLNFDKFVHLSLKALAKILPLMEQGMRYDEACKEAYGDHYGAKEQEDHRLLPPFVADDIRNPVVFRTLTQARKIVNEIVRRYGSPLRVHIETGREVGKSFSDRKEIEKRQEENRKERERAAAHFKELFPNFAGEPKAQDILKLRLYEQQHGKCLYSGKEIDLRRLPEKGYVEIDHALPFSRTWDDSFNNKVLVLGKENQDKRNRTPYEYLDGKGNSGAWRAFAERVSGCRFPYAKKQRLLTQKLDEKTEQGFLERNLNDTRYVARFLCQFIEEKMHLEGAGKKRVFASNGQITALLRGFWGLKKVREENDRHHALDAVVVACSSVSMQQKITRHFRYREELEHIDRETGEVIHGFPQPWEFFRQEVMTRVFSDDPVSELAEKLDSRPEAVHEFVTPLFVSRAPHRKVTGQGHLETIRSAKRLDEKISVVKLPLTQLKTKDIERIVGYPNREPALYDALAARLAAFKDDPAKAFSEPFYKTGKDGKCGVLVKAVRVENVQKSGLLVRKDESGKMQGVADNATMVRVDVFGKNGKNYLVPVYAWQVEKGELPNRAVVAYADEEDWDEMDDSFEFKFSLYPNDLVEVVTKKDKFFGYYSGFNRATGAINIKEHDLSKSKVKNGVYEGIGVKTAQSFQKYQVDTLGKTIRLCKPEKRMGFKKK

SEQ ID NO: 216 - protein, 1029 aa, Alicycliphilus denitrificans; identical to SEQ ID NO: 193

SEQ ID NO: 217 - protein, 1122 aa, Streptococcus suis; identical to SEQ ID NO: 87

SEQ ID NO: 218 - protein, 1428 aa, Parasutterella excrementihominis
MGKTHIIGVGLDLGGTYTGTFITSHPSDEAEHRDHSSAFTVVNSEKLSFSSKSRTAVRHRVRSYKGFDLRRRLLLLVAEYQLLQKKQTLAPEERENLRIALSGYLKRRGYARTEAETDTSVLESLDPSVFSSAPSFTNFFNDSEPLNIQWEAIANSPETTKALNKELSGQKEADFKKYIKTSFPEYSAKEILANYVEGRRAILDASKYIANLQSLGHKHRSKYLSDILQDMKRDSRITRLSEAFGSTDNLWRIIGNISNLQERAVRWYFNDAKFEQGQEQLDAVKLKNVLVRALKYLRSDDKEWSASQKQIIQSLEQSGDVLDVLAGLDPDRTIPPYEDQNNRRPPEDQTLYLNPKALSSEYGEKWKSWANKFAGAYPLLTEDLTEILKNTDRKSRIKIRSDVLPDSDYRLAYILQRAFDRSIALDECSIRRTAEDFENGVVIKNEKLEDVLSGHQLEEFLEFANRYYQETAKAKNGLWFPENALLERADLHPPMKNKILNVIVGQALGVSPAEGTDFIEEIWNSKVKGRSTVRSICNAIENERKTYGPYFSEDYKFVKTALKEGKTEKELSKKFAAVIKVLKMVSEVVPFIGKELRLSDEAQSKFDNLYSLAQLYNLIETERNGFSKVSLAAHLENAWRMTMTDGSAQCCRLPADCVRPFDGFIRKAIDRNSWEVAKRIAEEVKKSVDFTNGTVKIPVAIEANSFNFTASLTDLKYIQLKEQKLKKKLEDIQRNEENQEKRWLSKEERIRADSHGICAYTGRPLDDVGEIDHIIPRSLTLKKSESIYNSEVNLIFVSAQGNQEKKNNIYLLSNLAKNYLAAVFGTSDLSQITNEIESTVLQLKAAGRLGYFDLLSEKERACARHALFLNSDSEARRAVIDVLGSRRKASVNGTQAWFVRSIFSKVRQALAAWTQETGNELIFDAISVPAADSSEMRKRFAEYRPEFRKPKVQPVASHSIDAMCIYLAACSDPFKTKRMGSQLAIYEPINFDNLFTGSCQVIQNTPRNFSDKTNIANSPIFKETIYAERFLDIIVSRGEIFIGYPSNMPFEEKPNRISIGGKDPFSILSVLGAYLDKAPSSEKEKLTIYRVVKNKAFELFSKVAGSKFTAEEDKAAKILEALHFVTVKQDVAATVSDLIKSKKELSKDSIENLAKQKGCLKKVEYSSKEFKFKGSLIIPAAVEWGKVLWNVFKENTAEELKDENALRKALEAAWPSSFGTRNLHSKAKRVFSLPVVATQSGAVRIRRKTAFGDFVYQSQDTNNLYSSFPVKNGKLDWSSPIIHPALQNRNLTAYGYRFVDHDRSISMSEFREVYNKDDLMRIELAQGTSSRRYLRVEMPGEKFLAWFGENSISLGSSFKFSVSEVFDNKIYTENAEFTKFLPKPREDNKHNGTIFFELVGPRVIFNYIVGGAASSLKEIFSEAGKERS

SEQ ID NO: 219 - protein, 1371 aa, Lactobacillus buchneri
MKVNNYHIGLDIGTSSIGWVAIGEDGKPLRIKGKTAIGARLFQEGNPAADRRMFRTTRRRLSRRKWRLKLLEEIFDPYITPVDSTFFARLKQSNLSPKDSRKEFKGSMLFPDLTDMQYHKDYPTIYHLRHALMTQDEKFDIRMVYLAIHHIVKYRGNFLNSTPVDSFKASKVNFVDQFKKLNELYTAINPEESFQINLANSEDIGHQFLDPSIRKFDKKKQIPKIVPVSVDDKATDKINGKIASEIINAILGYKSKLDVVVQCTPVDSKSWALKFDEEDIDAKLQKILPEMDENQQSIIAILQNLYSQVTLNQIVPNGMSLSESMIEKYNDHHDHLKLYKKIIDQLADPKKKAALKKAYSQYVGDDGKVIEQADFWSSVKKNLDDSDLSKQIMDLIDAEKFMPKQRTSQNGVIPHQLHQRELDEIIEHQSKYYPWLAEINPNKHDLHLAKYKIEELVAFRVPYYVGPMITPDDQAKSAETVFSWMERKGKEAGQITPWNFDEKVDRNASANRFIKRMTTKDTYLIGEDVLPDESLLYEKFKVLNELNMVRVNGKLLKVADKQAIFQDLFENYKHISVKKLQNYIKSKTGLPSDPEISGLSDPEYFNNSLGTYNDFKKLFGNKVDEPDLQDDFEKIVEWSTVFEDKRILREKLNEITWLSDQQKDVLESSRYQGWGRLSKKLLTGIVNDQGERIIDELWNTNKNFMQIQSDNDFAKRIHEANADQMKAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGKPINIDEISTYDIDHILPQAFVKDDSLNNRVLVSKAINNGKSDNVPVQLFGAKMGHFWKQLAEAGLISKRKLKNLQTDPDTISKYAMHGFIRRQLVETSQVIKLVANILGDKYRNDNTKIIEITARMNHQMRDEFGFIKNREINDYHHAFDAYLTAFLGRYLYHRYIKLRPYFVYGDFKKFKEDKVTMRNFNFLHDLTDDTQEKIADAETGEVIWDRENSIQQLKDVYHYKFMLISHEVYTLRGAMFNQTVYPASDAGKRKLIPIKADRPINVYGGYSGSADAYMAIVRIHNKKGDKYRVVGVPMRARDRLDAAKKVSDADCDRALKDVLTPQLTKTKKSRKTGEITQVVEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVFDGNTKASSGKREILEEVLNGLHANPTFGNLKDIGITTPFGQLQQPNGILLSDEAKIRYQSPTGLFERTVSLKDL

SEQ ID NO: 220 - protein, 1090 aa, Sphingomonas sp.
MDWRLGLDLGANSLGWAALRLDRAGDPIGILAMGSRIFSDGRDPKSGASLAVDRRAARAMRRRRDRFKQRQAALLKYLIRDGLFPADQADRQRLADEDPYALRARALDEELSLFEIGRALFHLNQRRGFQSNRKADRGQDDEAGKIAVGVDRLNQQMEEQGARTLGEFLHQRRRAATDANHIPSVRTRLRPETGEGAKGDGYDFYPSRALIAEEFEEIWAAQAPHYPDTLTQQVHDRLYEIIFHQRPLRAPQVGQCTLVAGETRLPKAHPLFQKRRLLEEINALMIVRPGEIAQRLTPEERDTLYLKLKDKRTVSFATLRKTLKLDSAARFNKESENRTELKGDEVAAELGAKTRLGTRWQHLSGDQQWEVVHRLMALESQADEAAFRDWISQTYDLLPEQAAAVLGARLPQGHGRFGPTATTTLIDSLLHDRTEDGRVVVYSEAVQRSGLGHHSDLRHDRDDEDVTELPYYGVALERHIMPGTAEPTDPEEMRIGRLTNPTVHIGLNQLRHVVNRLIRAYGPPKEIAIELARELKLSEDEKKKRNSENRDNRLAAEGRSKKLEEIRQRDTGANRALLKLWEELNPGNVLDRRCIYTGEQISIDMLFSDRVEVDHILPFAQTLDDSNGNKLLCLREANREKRRRSPYEAWGHTDRWPDIAERASRLPKPKRWRFEPDAMQRFATEDGFLARHLVDTQYLGRLAREYLSWLYPGRGEGSGHVWVSPGRLTEMVRRKLGLNDLLPDHNFGGGADQPKNRLDHRHHAIDALVVAIVDRGMLQAIARASGQDGSEGRERIHIPAPWDGFRDDLRVAVNGIIVSHRPDHGTVAKAGLARGRDQTAGRLHNDTAYGLTGETDAKGNSIVVRRIPLSAIKKPADIARVRDPLLRNALAEFTKGLDGKAFEARIGRFHELGPLLYRGIRRVRVVETLTVIPIRDAEGRAYKGYKGDSNYRYDVWEMPDGKWRCQVVSMFDAHQSTEQARPHPAARKILSLQRNDILAIERTEGDRELVRVVKFSEKQFAVAPPHEGGSLKTRDGNADDPFRYLYPSPNTLKGWRARQVRIDELGRVLDPGFPARKSVRRTRPRAAPVD

SEQ ID NO: 221 - protein, 1000 aa, Kingella kingae
MARAQRRLISRRANRMNKLRRLLKQENVLQANDYDEKGLIIGLPNQAWELRAQGLDRKLEPKEWAAVLINLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQEQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 222 - protein, 1130 aa, Streptococcus pasteurianus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLKNEELFAALRTISKRRGISYLDDAEDDSTGSTDYAKSIDENRRLLKNKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVSTETGKLSTEQKESLVEFAKNTATLGPAKLLKEIAKILDCKVDEIKGYREDDKGKPDLHTFEPYRKLKFNLESINIDDLSREVIDKLADILTLNTEREGIEDAIKRNLPNQFTEEQISEIIKVRKSQSTAFNKGWHSFSAKLMNELIPELYATSDEQMTILTRLEKFKVNKKSSKNTKTIDEKEVTDEIYNPVVAKSVRQTIKIINAAVKKYGDFDKIVIEMPRDKNADDEKKFIDKRNKENKKEKDDALKRAAYLYNSSDKLPDEVFHGNKQLETKIRLWYQQGERCLYSGKPISIQELVHNSNNFEIDHILPLSLSFDDSLANKVLVYAWTNQEKGQKTPYQVIDSMDAAWSFREMKDYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGKNQVVDKQTGEILSVSDDEYKELVFQPPYQGFVNTISSKGFEDEILFSYQVDSKYNRKVSDATIYSTRKAKIGKDKKEETYVLGKIKDIYSQNGFDTFIKKYNKDKTQFLMYQKDSLTWENVIEVILRDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKGLNKPNISIYKVRTDVLGNKYFVKKKGDKPKLDFKNNKK

SEQ ID NO: 223 - protein, 1119 aa, Lactobacillus coryniformis
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 224 - protein, 1126 aa, Lactobacillus farciminis
MADRISLGLDIGVASVGFSVLDIDKGKVIELGARLFSATVAAGNQDRRDMRGARRLLNRNKQRRQDTGKLFKKFGLIDDFDKGSFYDNFNQNLNPYELRVKGLTEQLTKEELAESLYQIVKHRGISYALKDADVDEGGTDYSVSLKINSQELAEKTPAQIQLQRLNDYGKVRGQVVIGDDPDNQKVLLNVFPTSAYEKEAKQIIATQQQFYPESLTDKFTEEYCQILTRKRDYFVGPGNEKSRTDYGIYKTDGRTLDNLFEELIGHDKIYPEELRASAASYTAQLFNVLNDLNNLRILNYEDGKLTKEDKEKIIAEIKNNTTTINMLNVIKKVAGCSKDDIKGFRVNEKDKPEISSMPVYRKIHKDLLKAGVDISDWPVEFIDELSFILTLNTENGEIRKQLNNRLAPKFDFLNADLIQLIIDNKDSFEIKTNNKWHRFSVKTMNKLIPEMMERPVEQMTLLNEMGLVKKDKKRFENNKYLPYKEIAKDIFNPVASKSVREALKIVNAVLKKYGHIDYLVVEMPRDKNLKEEQDNIKEFQNKNKKAKDAAFEAFVKSVGSEQRVKEALSKNRKLQMKMRLWYQQQEIDPYNGKTIDATDLINNPDKFEIDHIIPQSISFYDSINNKTLCFASMNQVKGQKTPYEFMLEGHGQSYDKFKATVMANKNFGKAKRANYLFEENVSDIETRKRFLSRNLVDTRYSSRVVLNSLQDFFREKSADTKVTVIRGKFTSNMRKHWHIDKTRETFHHHAIDASIIAATPFLRMWKKGGTIFPVKVGEESIDIETGEILDDKNFDKAMYEEPYSGFVSEIMNADDRIKFSHQVDKKMNRKVSDATIYSTRTGKLAKDKKDAEYIVAKVKDIYSVDGFKKFKKVYDKDKTKFLLYKYDPRTFSKLERIISDCPDKVEKVQTNGKVKAVDISPFEMYRRDHGMIKKYSKKGNGPAIKQLKYLDKKLGSHIDITPANANGKHVILQSLKPWRTDVYLNHETGEYEIMGIKYSDLKFNKNEGYGIKKDKYLEIKKVEEVSEKSEFMFSLYRKDRVKVQDMKTGESVELLFWSRNFSNKKYAELKPISQAENDKKLPVYGKGRLIKRLIPKNCKIWKVNTTILGDPYYLEKESDSPKDILD

SEQ ID NO: 225 - protein, 1380 aa, Eggerthella sp.
MNLRHVGNYNIGLDMGTASVGWAAIDEQGELLHFKGKPTWGSRLFDSANTAATARMPRGQRRRYIRRRWRLDLLQKFFSEEMAEKDPEFFIRLRQSSLWPEDREGGHTAYHWPLFNDSDFNEKEYYEKFPTIFHLRQWLMETDEKADIRLIYLAFHNIVKHRGNFLQENNDSLSAQNANMRESLESFCIALEEWCDEKELTCSCDPQKLEHLFKEVKYRSDIRDGFAALLGLACSGENEVDVKAMAKEMGKAIVGYKADFSKIFTECDKEGSSFRLSDDEGPEAFLDICPDDGIALFEAIQMVYSSFILTGMLTEKGLSLSKISAYNQYGQDLESLKALVKEYVPNEYSSFFRGPTYSGSTEYDPSKAQGYTRYNLGPSKKGSGAKPMAYEDFKKSVEQLFANTNAINDERYKEMMGRFAEEKFLRRLRTSDNGRIPFQLNLEEMTAIIINQGKYYPFLLEQQEKLESLVRFRIPYYVGPLTRINARLDSKGNACFAWSKRKDGMDSASIKPWNWDEVIDKHASAQAFIERMTGTCTYLRGEPVLPRCSLLYEEYCVLNELNGARWTQDGDKFIRFDYKDRSDIIEELFKKRRGRIQYAAVADWMKQERSHANVHVSGGQGENAFESRLSSYHFFCNDVFGVDELPGSYVDMVEEIILWSTLFEDRSILREEIQRKYGDVLNEEQIKTICKKRFSGWGRLSRKLLCSLKAQTDNGPKSIMDILQEGDQNNGRVGRAMVFQEILHDEQLGFEQKIEEENTQSMLEGENLLIEDLPGSPAIRRSINQAVRIVDEIVGIAGHAPDNIFIEVTREDDTKKKGKRTTTRYSNIQKALEALKEEGAEALRELKTYKHNELDKRLSLYFMQNGKSLYSGIPLDIRRLSEYQIDHIIPQSYIKDDSYENMALVLPGENQSKADNLLISQDIRIKMKATWTALHKAGLMGDKKYNNLMNSSISDAKMKGFINRQLVETSQSVKLTQMMLSQKYPGAKVRPIKASISSQLRDACDLVKCREANDYHHAHDAYLACQVGRFVLKRHSSMFDNPIGMTKVIRDFVKRQGQEFKRNGKLPAYASRSGFIVQSFMRSGFDAETGELLRDDWNAPFEIARIKRCLNYRDCYISRMPMEDSGAFWDATIYSPKAGKKGALPVKQGLPVEKYGSYSREQFAYFFVYKAYNPKKKAYRLEFEAVPVRVASAVETRENALEEYAKSVAKQAGLEFVEVARPKVYKYQLIELGEDRLYITGKREVRNASQLAFSLDEIDLLKRLAEGEETSSEERERLFDVLIEKYARYAPRLARQLSVDSMSATFETLNAEEQLGILLSLVEIANGKRNMIDLSSAGGSKNAGCMNPTFSSELSSPGSNFTFIDQSVTGMFERRQRLEL

SEQ ID NO: 226 - protein, 1430 aa, Capnocytophaga canimorsus
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSHILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVDKNQQAVLFEEEKTIFELDLEAKQALFNELNLKGNLKAYYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTVNINKAKTEHEKIIKILKNEFGLPNPTRNDIIRYRLYEELKANGYKDLYTNEYIEKQDLFTKNIDIEHIIPKSRVFDDSFSNKTLSFRKTNLDKGERTAFDYIESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVIIDWTKRNDHRHHAMDALTVAFTKHNHIQYLNYLNARKNEKHREHSNIMGIQQLETIKVTDKNGNEKRVFKAPMPNFRQVTKAFLENVLISHKAKNKVVTKNKNKVAGSNKVQEVLTPRGQLHKETVYGKYQYYVQKEEKIGGKFDLETIKKVANPLYQSLLKKRLEENGGDPKKAFTGKNSLAKNPIYLDDAQTEQLPEKVKLVWLENSFSIRKDITPENFKDEKLIDKILDEGVKRILKERLQSFGNDAKKAFSDLDKNPIWLNKEKGIAIKRVAISGVANAEPLHTKKDHLGKEILDKEGKSIPVDFISTGNNHHVAVYRDEKGNLQEKVVSVFEAVVRANQGLPIIDKTYNQHLGWEFLFTMKQNEMFVFSNESTGFNPNDIDLLDPKNKKIISPNLFRVQKFSKLQYGNSFVREFVFRHHLETTVEDRKELQGITYKQMKNSAFFNDIIKVRINHLGGIVSVGEY

SEQ ID NO: 227 - protein, 1348 aa, Finegoldia magna
MKSEKKYYIGLDVGTNSVGWAVTDEFYNILRAKGKDLWGVRLFEKAKTAADTRTFRSGRRRNDRKGVRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKQQLILLINDLLKIELEEEFMDSIFEILADVNEKKTEKKNILKELINAQDFNKQEGKILYSIFESIVTGKAKIKNIISDEDILEKIKEDNKEDFVLTGDSYEENLQYFEEVLQENITLFNTLKSAYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKYYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPIDTDVKLKLIEELFKKKTKVTLKSIRDYMIRNNFADKEDFDNSEKNLEIVSNMKSYIDFNNILGDKFELEMVEDLIEKITIHTGNKKLLKKYIEETYPDLSSSQIQKIINLKYKDWGRLSRKLLDGITGTNIETGEIDTVINFLRNSSDNLMQIIGSQNYSFNNDIDKLRKKYIPQEISYEVVENLYVSPSVKKMIWQVIRITEEITKVMGYDPDKIFIEMAKSEEGKKTTISRKNKLLALYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYKKSKIIPVKAILASDLRKDMNTLKSREVNDLHHAHDAFLNIVAGDVWNREFTSNPINYVKENREGDKVKYSLSKYFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 228 - protein, 1352 aa, Megasphaera sp.
MKKRNREEYYVGLDIGTSSVGWAVATPDYRIPKFRGHKMWGSRLFAEGKRAAERRQFRTNRRRLARRRDRLQILEELFAEEMAKVDNTFFMRLKESKFFLEDKTVKEKHILFSTDKFDADRFYKDNPTIYHVRKRLMEEEPQDIRELFLAVHHILKYRGHFLFAGSLEQNGASIEELVRTLLGKQGLAILDDTIDSNEMVNILKNTGETKSDRKKDVQELWNPLKDKVKKAQAAEMAGLVLGLKSDISKLFANSDYKDLDSSIKNINFSSGDYEEKRDDYANSIGDDIVLLDTMKALYDTLILSQILQGKRSISAAKVEDYNTHKEQLRALKAILKPHKRLYNEMFRENNKKDLSNYVAYISSYSEGKRVNREGFYKYVQAVLKQVDDSDSKQAILEAIRLETFLPLLRVKDNAVIPHQIHQAELEAILETARKKYNFLNDVSDGVSVKDKIIQLFTFRIPYYVGPLNPHSGETVADRKQGTGWVVRKQRGKVYPWNFADMVDVKASAEAFITNLTNKCTYLIGEDVLPKRSLLYSEFMLLNELNMIKYDGHELPVAIKQLYIEQVFKQEHKKQTKGRVLDFLKRNGLITGSATAVITGMDDAIKGDLQSYRDMVRIFGAGFDHSMAERIIRWVTLFGEAKDILENKIREVYGNSISDSQMRAIKKLKYADWGRLSQAFLIAVKGCDKSGVERNIITCLRASSQNLMEILSDQGTYIKQIKAWNHQHTTNMMDTLDYQLVDDLYVAPSVKRSIWQSLCIVEELVKIMGQAPKKIFVEVTRTKQAEKTKKDSRKKRLVELYTAIGKEGAAWKKEIEAHQAGDFRRKKLYLYYTQMGRCMYSNEPIAMDALFTSAYDIDHIYPQSLTKDGSWDNLVLVKSQLNKEKSDQYPLRPAIREKNKAHWQYLCRAGFISEKKYERLMRTTELTAEELSGFIARQLVETSQATKAVTGLLERIYTNTEICFVKAETVSQFRHQHNFIKIRELNNYHHAKDAYLNIVVGNVYHEKFTKNPWEFIARSTERRPYNLNRMYDFDLLKQGRVIWQVPKSLETVQAMMKSNDVRITKKLLVQKGELYDATITKAHKAKEGTYFPLKGADARLRDVHRYGGYEKIKIAYYSVFSCREKASNTIHTLIIPIPVYKAGLLQTEADLTAYAWQTKQKTKPIKDIYSAITPIYKKLCINTVVKIDGFKYFLGGKTGDYMWLDPAIPVVLDEQAAAYLKAISKVGRADDVENTAQAIDLITAEANEAFYDVLLKKMEAKIFAKAYQTIVEKLASETARERFRELSIGAQCSCLLEILNLLANNKTTFTFFKDKMGVTMSRRKQPMDLTKLEECIVYETSITGLYEKAVSLL

SEQ ID NO: 229 - protein, 650 aa, Haemophilus pittmaniae
MENKNLHYILGLDLGIASVGWAVVEIDKEENPLCLIDVGVRTFERAEVPKTGESLALSRRLARSARRLTQRRVARLKKAKRLLKLENILLSTDERLPHQVWQLRVEGLDRKLKRQEWAAVLLHLIKHRGYLSQRKNESKSENKELGALLSGVASNHELLQQTTYRTPAELAVKKFEVEEGHIRNQQGAYTHTFSRLDLLAEMELLFSRQQHFGNPFASEKLLENLTALLMWQKPALSGEAILKMLGKCTFEDEYKAAKNTYTAERFVWITKLNNLRIQENGLERALNDNERLILIEQPYEKAKLTYAQVRSILNLSDEAIFKGLRYSGEDKKAIETKTTLMEMKAYHQIRKVLEGNNLKAEWTELKENSTLLDEIGTAFSLYKTDEDISTYLAGKLSQPVLNALLENLSFDKFIQLSLKALYKLLPLMQQGLRYDEACHEMYGDHYGKKTYGKKTEENHYFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKNNAS

SEQ ID NO: 230 - protein, 1062 aa, Ralstonia syzygii
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 231 - protein, 1052 aa, Haemophilus parainfluenzae
MENKNLHYILGLDLGIASVGWAVVEIDEKENPLRLIDVGVRTFERAETQKGESLALSRRSARSARRLTQRRVARLKKAKRLLKSENILLSTDERLPHQVWQLRVEGLDRKLERQEWAAVLLHLIKHRGYLSQRKNESKSENKELGALLSGVASNHELLQQATYRTPAELAVKKFEVEEGHIRNQQGAYTHTFSRLDLLAEMELLFSRQQHFGNPFASEKLLENLTALLMWQKPALSGEDILKMLGKCTFEDEYKAAKNTYTAERFVWITKLNNLRIQENGLERALSDNERLMLIEQPYEKAKLTYAQVRSILNLSDDAIFKGVRYSGEDKKAIETKTTLMEMKAYHQIRKVLEGNNLKAEWVALKANPTLLDEIGTAFSLYKTDEDISAYLAGKLSQPVLNALLENLSFDKFIQLSLKALYKLLPLMQQGLRYDEACREIYGDHYGKKTEETHHFLPQIPADEIRNPVVLRTLTQARKVINGVVRLYGSPARIHIETGREVGKSYKDRHELKKRQEENRKQREKTISEIKTLFPNFSGEPKGKDILKMRLYYQQNAKCLYSGKPLELHRLFEQKYVEVDHALPLSRTWDDSFNNKVLVLANENQNKGNLTPFEWLDGKNNSERWRTFKALVETSAFPYAKKQRILSQKLDEKGFIERNLNDTRYVARFLCNFIADNMHLTGEGKRKVFASNGQITALLRRRWGLAKSREDNDRHHALDAVLVACSTVAMQQKITRFVRFKAGDVFTGERIDRETGEIIPLHFPTPWQFFKQEVEIRIFSDNPKLELENRLPDRPQANHEFVQPLFVSRMPTRKMTGQGHMETVKSAKRLNEGISMIKMPLTKLKLKDLELMVNREREKDLYDALKTRLEAFNDDPAKAFAEPFMKKGGAIVKSVRVEQVQKSGVLVRQGNGVADNASMVRVDVFTKDGKYFLVPIYTWQVAKGILPNKAVIQGKDEEDWEDIDDATFQFSLHPNDLISVKTKKDEFLGYFNGLNRHTGGINIRTHDLEKSKGKQGIFEGIGVKIALSFEKYQIDELGKNIRLCKPSKRQPVR

SEQ ID NO: 232 - protein, 1331 aa, Lactobacillus sanfranciscensis
MNKQPYNIGLDIGTSSVGWSATELDNRLLHIKGHNGIGVRLFKEGESAADRRGFRTTRRRLARRKWRLRLLNEIFATEIAKVDPSFFARLKQSNVSPKDPNKTMFENILFDDENLDDQKFHHDYKTIYHLRQAIINHPEQKFDIRLIYLAMHHIIKYRGHFLNQANVQDFKGGKIDLEKSFKALNDIFENQGRDLRLVTDKANQYVKVLSDNAKTRSDRKKELSKLLYVPIDKDTDKNSKKVTGEILKAILGNKAKFDVIFGIEVENPKEWVLTFNSDDFDDKIEGLSSQMTDEDSEILLILKELYFALNLSDILNNSVTDKNAKTLSEAMINRYDDHKNQLAMLKKVIDSSDKKHAKELKEAYSAYIDGENNKKISFEDLKKRIQKNLVDSELSQKINDLLDHDYFLPKQRSKENGAIPHQLQQQELDQIIESQKQYYPFLAELNPNEKRSRQAKYKLDELVAFRVPYYVGPMVEVTDSNQENNGKFAWMIRKEQGEITPWNFDEKVDRTETATKFITRMTTTDTYLIGEPVLPKNSLLYQKFVVLNELNNLKINQEIITPGQKQYLYEHVMKKNKRVTLKKIADALVIKGDYPYAPEVKGTTDQKNLNNGLTTYIDLAKIFGNELDDVDREADFEKIIEWSTIFEDQHIFALKLQELKWLTEKQRNQVVKLRYQGWGKLSKELLAGLVDDNGQRIIDLLWSDNQNFMQIVNQKSFKESIADHNGAHLEEKNLKDVINDLYTSPQNKKAIRQVILVVDDIINAVGYEPANIMMEFAREDSNDHRLTNSRSRQLENVYKDITNSWFDNDSVKDELEDKIKNKDKFTDRLYLYFTQGGKDLYTGEPLNIDDLSSYDIDHILPQSFILDNSLDNRVLTSQRNNRVSKEDQLPGELFGTKMHAFWKRLKAAHLISNKKYYNLTLTPNSISKFNNQGRFINRQLVETRQVIKLAAEILHNRYSEEKGTNIVTIKANLTHHMREKFNFYKNRNVNDYHHAFDAYLTAFVGNWLLQQYPKLKPYFVYGDFAKTEINNLKSFNMLYKFEQAHQLNEKDGKIAKDADALLGYMKNVYHFKKMLVTKKLETNHGALFKQTLYPSPAHDIKKRQLIKPKDNRPTDIYGGYTHEERKYMSLVKVIGKKDNEYRMANVPLLKINKNNDIKEILKSQFSNKKFEIVLPKVLKNQLFSENGALFVIGSKGYKYNANQLVLSDLDMKLLNDLSNNKSIDEVTINQLFKNIVDSTNKYMPLYEIKNLNEVVEKFNNLEFNDKKKTITDFLLATHANPTMSNLKNIGLPSYFGRFTSGNAGIKLSENANVIYQSPTGLFSRKVKISDF

SEQ ID NO: 233 - protein, 1473 aa, Flavobacterium branchiophilum
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHNQFTAFVEGIDFKVLPSGKFEKI

SEQ ID NO: 234 - protein, 933 aa, Mycoplasma iowae
SVRDYSDGPGSEKSPTPYGLWRLNKEGKVEKIGENLWDVLVGKCTIYGNDDSIKDEKTKLRGGKNSPIAEVFNFINDLTNIYLFSSSKLKLNSKTKLSILDEFNISLKTSKPIKSFSEKKLVKHIISTTEFKDINFDDVYGYRIDTSKKPLFTKLENTITIAKWLLDNNVYNELNIYDQEDLIKINNIFVILQKSMDINKRAQLVSDEYKIDLPICLELVKKIKGVMQTHSFSYKAMLEYIPVGIKYNDLETGEDTSINASTYFVDKINNLNTKLLFNGRPRKYIPKNIFEDGIISPTSKRAFIQTINVLNKIIKVYSKDYDIDNIAIELPRDKNTAEERKKISSNQKKAGEEIAEVLKFAGLNVEEYTSKLNSKTKLKLKLLKEQNYKDIYDGQEIDVIDVIKNSNKYHEEHIIPYSLCFIDSRRNKVLTKFENNKQKGNKTPFQWLSSIGKYAEFKDRVEKLFVEQKISKAKKELLLFEQDPRTEMLGFIEKNLSDTRYASKLVFDTFRDFFKVNNPNVKIKVINGALTNYARYNLFATYKDGLLERKGIMKQREFYEHHGIDATILAFLGSNHKINQLLKLSHKFKKQDDNKIYDENTGELIEFTKDFLSDEARKKAMELSKQIFEIPCKFSRPIYRKSNVSFSNETLISMKWIDDKYTKGVKINKLSLVNKDLDLNEYFADYETNEMKNLICYQEDKTLYNKLKNIYDKYNNFVENSNIKPVKNPFINYMISNFSSDDSKIQNFKHIIFYDHKGNKKFVKSLKVCGDEKNLSNIVLRKDQKDIMNSKKIKKSGILESLNPISARIYKDNKGKYITIPINSLVLNWTKKGLEIDNEKLCNILKSKNIFNNQFIEINAGQSIINNENKLFYFVGGGDFKVNKLEIKSQFCDNEIFFPRKQMNISIATIIDNYKLCEVDELGKIYNIRKIVL

SEQ ID NO: 235 - protein, 1358 aa, Acidaminococcus intestini; identical to SEQ ID NO: 99

SEQ ID NO: 236 - protein, 983 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 237 - protein, 1338 aa, Streptococcus macacae
MTKPYSIGLDIGTNSVGWAVVTDGYKVPAKKMKVLGNTDKSHIKKNLLGALLFDSGNTAKDRRLKRTARRRYTRRRNRILYLQEIFAEEMAKADESFFQRLNESFLTNDDKEFDSHPIFGNKAEEEAHHHKFPTIFHLRKHLADSTEKSDLRLIYLALAHMIKFRGHFLIEGQLKAENTNVQTLFDDFVEVYDKTVEESHLSEISVSSILTEKISKSRRLENLIKYYPTEKKNTLFGNLIALSLGLQPNFKTNFKLSEDAKLQFSKDTYEEDLGELLGKIGDNYADLFISAKNLYDAILLSGILTIDDNTTKAPLSASMIKRYEEHQEDLAQLKKFIRQNLPDQYSEVFSDKTKDGYAGYIDGKTNQEAFYKYIKNMLSKTEGADYFLDKIDREDFLRKQRTFDNGSVPHQIHLQEMHAILRRQGEYYPFLKENQDKIEKILTFRIPYYVGPLARKGSRFAWAEYKADKKVTPWNFDDILDKEKSAEEFITRMTLNDLYLPEEKVLPKHSLVYETFNVYNELTKVKYVNEQGKAIFFDANMKQEIFDHVFKENRKVTKDKLLNYLNKEFEEFRIVNLTGLDKENKAFNSSLGTYHDLRKILDKSFLDDKVNEKIIEDIIQTLTLFEDREMIRQRLQKYSDIFTTQQLKKLERRHYTGWGRLSAKLINGIRDKQSNKTILGYLIDDGYSNRNFMQLINDDSLPFKEEIARAQVIGETDDLNQLVSDIAGSPAIKKGILQSLKIVDELVKVMGHNPANIVIEMARENQTTAKGRRSSQQRYKRLEEAIKNLDHDLNHKILKEHPTDNQALQNDRLFLYYLQNGRDMYTEDPLDINRLSDYDIDHIIPQSFIKDDSIDNKVLVSSAKNRGKSDNVPSEDVVNRMRPFWNKLLSCGLISQRKYSNLTKKELKPDDKAGFIKRQLVETRQITKHVAQILDARFNTKRDENKKVIRDVKIITLKSNLVSQFRKDFKFYKVREINDYHHAHDAYLNAVIGKALLDVYPQLEPEFVYGEYPHFHGYKENKATAKKFFYSNIMNFFKKDDIRTDENGEIVWKKDEHISNIKRVLSYPQVNIVKKVEIQTVGQNGGLFDDNPKSPLEVTPSKLVPLKKELNPKKYGGYQKPTTAYPVLLITDTKQLIPISVMNKKQFEQNPVKFLRDRGYQQVGKNDFIKLPKYTLVDIGDGIKRLWASSKEIHKGNQLVVSKKSQILLYHAHHLDSDLSNDYLQNHNQQFDVLFNEIISFSKKCKLGKEHIQKIENVYSNKKNSASIEELAESFIKLLGFTQLGATSPFNFLGVKLNQKQYKGKKDYILPCTEGTLIRQSITGLYETRVDLSKIGED

SEQ ID NO: 238 - protein, 1265 aa, Mycoplasma ovipneumoniae
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 239 - protein, 1535 aa, Flavobacterium columnare
MTKILGLDLGTNSIGWAIRDTENEGINQILDKGARIFSEGVKSENGKEISRAAERTAYRSARKIKYRRKLRKYETLKVLSINGMCPLSVEEVEQWKKSGFKEYPLNPEFLDWLRTNEDKNINPYLFRDKASKQKVTLFELGRALYHIAQRRGFLSNRLDQSAEGVFEEHNPQIQNLIEDLDSSNTILNELKEYYINLGIIDETEKSGFKKDLDEGEKKLKSLYNSLVAITKKNANDIETCKQELIARLNKKEDLGKVKGKIKDISQAMLDRNFKTLGQYFFSLYNKERIRNQYTSREEHYLEEFIIICQTQGIEGINTNEKLPEKKFTGLAKDLYRAIFFQRPLKSQKGLIGKCSFEKNKSRCAVSHPDYEEFRMWSYLNTIKIGTQSEKTLRFLTLEEKLKLVPKFYRKSDFNFEVLAKELVEKGASFGYYKSSKKNEFFYWFNYKPTDSVSACVVSASLENAIGKDWKIKTFEYQTRNTEKNEVTKSVDYKDLWHLLSVATSDTYLYDFAIEKLKLEPKNAKAFSKTKLKKDFASLSLAAIAKILPYLKQGLLYSHAVFMANIENIVDADIWKDEEQQKFIQSKIVELVDNYIVEKSKLELINGLLKIYNTEDKEGRKVYYSKEAESLFEADLRKKLVPFYKANIIIEEHEQEIIFQDLFPILMDQLKKQEFIKIGRLDKQIEAFLEGENEEGQIFCNHTDKLKKLYHPSDIEVFKKKTIKDEWGNEKVVLGSPLTTSIKNPMAMRALHQLRKVLNTLIANDQIDEDTRIHIEMARELNDANKRKGIQDFQNENKKFREEAIKEIKKLYLEECHKDVNPTEDDILRYQLWLEQGKCEIYEEGNNISICDIIGSNPSYDIEHTIPRSISQDNSQMNKTLCSLKFNRSIKKQKMPVELSNYNDILPRIAHWKKEAEELTRQIETISRSIKSAATKVAKDKNIRKRHYLTLKRDYILGKYERFTWEEPKVGFKNSQIPDTGIITKYAQAYLKSYFKRVESVKGGAVAEFRKLWGIQESFIDENWWKHYKDKDRDKHTHHTIDAITIACMPKDKYDLLAHAWRLEDEQDKKAAKVLIEQAKPWKTFKEDIEKIETEILVSHFTPDNVKKQSKSIIKNRGKKVYVLKNELPVNFKNKIEGKDYFKLKFDSKILYKIPKKKEKQTDTFYEELPKNYLNGVEGKDYFKINTTGKTFYKIPIFNQGDTIRGSLHQETTYGAIKLPDIDIETKKPLHTDKGGFILKKDIKGNEIVFFVVRKEISKISENDVQNIVDNVVRKKIENAIANSLITFKIVKKKKVAVIKEGVTIWMREPNIEKGIEGIPIKKVRIITNSVKNPIEIKVHSPLSKSRHKHKQKVYGQNDENYAMALYELDGKREFELINNFNLAKLLKQSQSYYPLHKEKEIKGKKILVPIEKRNNKDVILKRGQQVVFYDKTVENPKDISEIIDFRERIYIIEGLTIQRQKDKKTSKVNEYGIIQLRHFKEARKSEEISKDNFKPDGEFKINENKPTRKMNHNQFTAFVEGIDFKVLPSGKFQKI

SEQ ID NO: 240 - protein, 1459 aa, Flavobacterium columnare
MKFNLGLDIGTNSIGWALVNEDYENKKGKIIAAGSRIIPMTQDILDKFGSGAITETQTALRTDYRSKRKLIQRFLLRRERLHRVLNVLDFLPKHYAESIDFEKYFGKFLPNTEPKLAYNQNQFIFQNSFLEMLKEFQEKHPELLTNNKKIPYDWTIYYLRKKALNQRIEKEELAWLLLQFNQKRGYNQLRDEEEESVPNKQVEFYSLKIIDVVADQPKEGRDKRWYSINLENGWTYRRESKTPLFNWEGKTKDFIVTTDLNQDGSIKKDKEGKEKRSFRAPSEGDWTLLKKKTEKEIYESGKTLGTYIYDALLNTPDLKIKGDFIRTIDRSIYKEELQQIINKQKEYHLELNSSKLYKACLEELYPKNEIYKSALKNKDIAYLFINDILYYQRPLKAPKYNIGKCTYESRTFKKEDKKIREYIPAVAKSHPLFQEFRLWQWIKNLKIYEKLSSDNCTDFFLTNEQDFENLFEFLWNKKEIDHKGILEYLVKTKFPDLKPKQVKTKVKEYRWNYVYDHEKDESKTYPCGETYFLLKNKLDKIYNAQDDFLDKERLYNLWHIIYSVTDKKQYEKALAKFALKNHLDTKSFVNTFKRIPPFKNDYAIYSLKAIKKLLPLMRVGKYWNYDDIDPITKQKIQCIITGEENDTISTLVREKTNHFSNENDFKNLPLWLAGYIVYNSHNESSEIEKWKSPQDIDTFLKKFKQHALRNPIVEQVVTETLRVVRDIWSKKGQGKKDFFNEIHIELGKDLKNPVDKRRKLSSTNTKNESTNTRIKALLIELFTQGVENVKPNSPKHQEILKIFEEGALNSGIEIEEDIIKISNTDQPTKKQLELYILWLEHKYKSPYTGQSIPLSKLFTPNYEIEHIIPRSKYYDDNLSNKVICETEINRLKNNQLGYEFINNHEIREVTLEEGKTIRLLSPEQYWNFVTTYYAKNKAKRENLLLKELPVQMVEKQLNDTRYVSKYVMQLLSKIVRKEDGTDNGINSTNILSISGKMTRALKNDWDLNDVWNDLLLYRFERLNTITKTNLFTTYSEQKQKRMPIVPDQYAKGFHKKRLDHRHHALDAIVIACITRNHINYMNNQNIQGEKLKKNAIEKENYREILQKSRLDIRAQLCEKKYNDNDPTKYNWVFIKPWADFTENTKDILESIIPSFKQNLRIINKTVNYYEKYNENGKKVKVRQIKGDNWAIRKPLHKETISGKVHLSYKTPAKGKILTATRKVLDSSMDFKSIEKITDTGIQKILKNYLEYKKSPELAFSPEGIEELNATITKYNNGFHHKPIYKVRIYEEGVKFPLGNKGNKKSKYVEAEKGTNLFFAIYKDQENNRYFETIPFNDVLETLKKGMSAVPEKNQEENTLVFALSPQDLVFVPTLDEIENPDIVDFKNLTKDQTNRIYKMVSSSGKQCFFIKAEVATSIVNKMEFSTSNKMENSIEGIQIKSNCWKLKLDRLGTITRVIK

SEQ ID NO: 241 - protein, 1389 aa, Oenococcus kitaharae
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 242 - protein, 1425 aa, Prevotella micans
MIQKIFGLDLGTNSIGSSVRNLELGENLTEQLEFFSSDIFGSSVSKNSNGREYSLAGNRSAHRRSRGLNEARRRKLWATLDLLIEHGLCPMSPDSLMQWRTYDKQKGLYRQYPIEDKDFNAWIMLDFNGDGKPDYSSPYQLRRELVVRQFDFDQPIERYKLGRALYHIAQHRGFKSSKGETIADQEKNEKKPIAEEGADIANEMKASETKLSKGLVAYMQENHLKTVGEAFAKLEDERVRIRNNESYRAIRSQYQDEIKEIFTYQKKLSVESELYERLTSEKKGVGTIFYKRPLRSQRGNVGKCTLERNKPRCPIGRPEFEEFRAWTLINNIKIRETAGEPYKQLPIKLRQELLKDCFLSKVKADFKFEDIRKYIEKRLGLSFSNDDKTINYKDSVSIAACPVTVRMKKLLGENWANCRIDGEKRRQAHGKNNNNEHIVSYTEEDIWHVCYNAEDPEEVSNFARKALHWDENKIKELVRLWTSIPQGYAMLSLKAIRNINRMLLLGLKYSDAVLLAKLPDIVPVSDEDILAITKEFLQLEDKLNQEKQINNIVNSLIANYKSKLEENRFADHNYQYQLGEGDDEDINTQIKSHIGAKLWVQIGADEQTKIFQAVRSKYQDFFKSYKRKFVESPKLGELLVAFLTEKFPNVKSKQWERLYHPSQIAIYRPIPVDNDRSKLRLGNPNIGAIKNPTVMRVLNTLRRRVNQLLDDGVISPDETRVVVETARELNDANTKWALDRYNRIRRDENEKIRKILKELNPTTNSISEQDIDKARYIFEQCETDFYTDGKVPYYNKDIKKYKLWLEQGGQCLYTGQTINLTNLFNPNAFDMEHTIPKSISFDNSDQNLTLCESYYNRFIKKNNIPTDMPNYDKDVTINGKEYTAIKPRLQRWKERVDRLSRNVDFWKGQARRAQDKDRKDECIREKHLWDMELAYWKGKLERFTMTDVTDGFKNSQLVDTRVITRHAVLYLKSIFNHVEVQRGETTAEFRKILGLQSIDEKKDRSLHSHHAIDATMLTVIPSAAKRDRMLELFYKIEETKKALKNYNDNNKTGLNLELKGLEEKLDKEKKDCRVGRRVNDLDRFINENIIVSHHTKDQALTPAHRRLRKRGKIVGGKEHPRWQTGDSLRGEIHKASYYGAITQFAKDANGKVLMKDGQAQIDPTIYYVIRRELKYKRSTQDSGFTNWEDLEKVIVDTDLFGLMKGQFPEGTSFKDACEQGFYMIKKGKNGEGDVKTHRIRHVRCKAVKTALRIKEQTYKSSKDYKQFFYAAVGDLYVMCYYTDGKKRDFKIYSLYDISNHRKSGTEDIPKFITDKKGNHLPLDYKLRTGDMVLLYKDNPEELKDLDQVNLKRRLYKVNRFESEGLIILLTHHLSTTTERGCSIGKIENYQNLPTAIRCGIKTIKFLIMGKHRDFVIRNGNIEFKH

SEQ ID NO: 243 - protein, 1473 aa, Mucilaginibacter paludis
MKNILGLDLGTNSIGWALIEKDTDQKNGNILGTGSRIIPMSQDIKDEFGKGNSISQTADRTKFRSVRRLRERHLLRRERLHRVLNVLGFLPKHYADQIDFKKRLGKLVNETEPKLVYDNKNFIFKKSFEAMLSDFNQHQPLLLADGKKVPFDWTIYYLRKKALTEKIEKEELAWLILNFNQKRGYYQLRGEEEEENPNKMVAFHSLKIVEVIADESQKGKAETWYSLILENGWIYRRSSKTPLYDWKGKQRDFIVTTDLNDDGSIKTDKEGLEKRSFRAPVEDDWTLVKKKTEQEINRSHKTVGTYIYENLLQDPKQKIKGKLVRTIEREFYKDELKMILKNQQKFHPELNDEHLYINCVRELYRNNQAHQTILSKKDFVHLFIDDIIFYQRPLRSQKSSISNCTLEFRKYKNENGTDQTDYLKAIPKSHPLFQEFRLWQWIYNLGIYQKEDDTNVTDELIKNIDGYQDLFDFLNNKKEIRQDILIKFLVEQTGLKGKPLSSVVAKYRWNFVEDKIYPCNETGTQIRTRLAKVENTPEDFLTAETEIKLWHIIYSVNDKADYEKALKTFAEKHNLDTHSFVENFKKFPPFKSEYGSFSEKAIKKLLPLIRLGKYWSWENIDKKTQERIEKILTGEFDEAIKSRVRDKAIHLTEEDHFQGLQLWLASYVVYGRHSEADNLDKWHTVADLEDYLAEFRQHSLRNPIVEQVITETLRVVKDIWLQYGQGAKDFFSEIHIELAREMKNTGDERKRLTSLVTDNENTNLRIKVLLSELLNDGNVENVRPYSPMQQEALKIFEDGVLNSDIEIEDDILKISKMAQPTNTELKRYKLWLEQKYRSPYTGQIIPLNRLFTADYEIEHIIPQSRFFDDSFSNKIICESAVNQLKDKQLGLEFIKNHSGTIVKLGMGKTAKILDVESYNEFVKGNYTKNISKRNKLMLEEIPDKMIERQLNDTRYISKFIISALSNIVRSESNDDGFNSKNVLPGNGKITSRLKQDWGMNDIWNELILPRFERMNKITDSAVFTAWNENNQKFLPIVPLEFSKGFQKKRIDHRHHALDALVIAASTREHINLLNNEHAKSDKRFDLNRKLRKFEKVAYNDPKTGKRIEKEVPTIFLKPWETFTVDAKNSLESIIVSFKQNLRVINRATNYSESYNDENGALRLGKDGNPLKEKIKQSKGDSWAIRKPMHKDFVYGKVHLQNVKLPKDKFITAIRKSLDVTFDLKRIETITDTGIQKILKNYLHSKENKVELAFSPEGIEDMNQHIERYNDGKKHQPIHKVRVFEIGSRFSLGESGNKKTKFVEAAKGTNLFFAVYQDDNKGKRNYETIPLNIVIERQKLGLHSVPTEDAKGGKLLFHLSPNDMVYVPTSEELEDNLASVNIKRLNTAQRKRIYKVEKASGVECYFIRQDIAYLIKNYDAKTKIGELESQNKLQTTMTDDRLKITDVCVKLNIDRLGSIAETFLGNQYGASKKT

SEQ ID NO: 244 - protein, 1365 aa, Filifactor alocis
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 245 - protein, 1130 aa, Streptococcus macedonicus
MTNGKILGLDIGIASVGVGIIEAKTGKVVHANSRLFSAANAENNAERRGFRGSRRLNRRKKHRVKRVRDLFEKYGIVTDFRNLNLNPYELRVKGLTEQLTNEELFAALRTISKRRGISYLDDAEDDSTGSTDYAKSIDENRRLLKTKTPGQIQLERLEKYGQLRGNFTVYDENGEAHRLINVFSTSDYEKEARKILETQADYNKKITAEFIDDYVEILTQKRKYYHGPGNEKSRTDYGRFRTDGTTLENIFGILIGKCNFYPDEYRASKASYTAQEYNFLNDLNNLKVPTETGKLSTEQKESLVEFAKNTAILGPAKLLKEIAKILDCKVDEIKGYREDDKGKPDLHTFEPYRKLKFNLDSVNIDYLSREVLDKLADILTLNTEREGIEDAIKRNLPNQFTEEQISEIINVRKSQSTAFNKGWHSFSAKLMNELIPELYATSDEQMTILTRLEKFKVKKKSSKNIKTIDEKEITDEIYNPVVAKSVRQTIKIINAAVKKYGDFDKIVIEMPRDKNADDEKKFINKRNKENKKEKDDALKRAAYLYNGTDKLPDEVFHGNKQLETKIRLWYQQGERCLYSGKPIPIQELVHNSNNFEIDHILPLSLSFDDSLANKVLVYSWTNQEKGQKTPYQVIDSMDAAWSFREMKEYVLKQKGLGKKKRDYLLTTENIDKIEVKKKFIERNLVDTRYASRVVLNSLQSALRELGKDTKVSVVRGQFTSQLRRKWKIDKSRETYHHHAVDALIIAASSQLKLWEKQDNPMFVDYGNNQVVDKQTGEILSVSDNEYKELVFQPPYQGFVNTISSKGFEDEILFSYQVDSKYNRKVSDATIYSTRKAKIGKDKKEETYVLGKIKDIYSQNGFDTFVKKYNKDKTQFLMYQKDPLTWENVIEVILGDYPTTKKSEDGKNDVKCNPFEEYRRENGLICKYSKKGKGTPIKSLKYYDKKLGNCIDITPEESRNKVILQSINPWRADVYFNPETLKYELMGLKYSDLSFEKGTGNYHISQEKYDAIKEKEGIGKKSEFKFTLYRNDLILIKDIASGEQEIYRFLSRTMPNVNHYVELKPYDKEKFDNVQELVEALGEADKVGRCIKSLNKPNISIYKVRTDVLGNKYFVKKEGDKPKLDFKNNKK

SEQ ID NO: 246 - protein, 1367 aa, Streptococcus pyogenes
MDKKYSIGLDIGTNSVGWAVITDDYKVPSKKFKVLGNTDRHSIKKNLIGALLFGSGETAEATRLKRTARRRYTRRKNRICYLQEIFSNEMAKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQIYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGAYHDLLKIIKDKDFLDNEENEDILEDIVLTLTLFEDRGMIEERLKTYAHLFDDKVMKQLKRRRYTGWGRLSRKLINGIRDKQSGKTILDFLKSDGFANRNFMQLIHDDSLTFKEDIQKAQVSGQGHSLHEQIANLAGSPAIKKGILQTVKIVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 247 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 248 - protein, 1375 aa, Lactobacillus johnsonii
MTKIKDDYIVGLDIGTDSCGWVAMNSNNDILKLQGKTAIGSRLFEGGKSAAERRLFRTTHRRIKRRRWRLKLLEEFFDPYMAEVDPYFFARLKESGLSPLDKRKTVSSIVFPTSAEDKKFYDDYPTIYHLRYKLMTEDEKFDLREVYLAIHHIIKYRGNFLYNTSVKDFKASKIDVKSSIEKLNELYENLGLDLNVEFNISNTAEIEKVLKDKQIFKRDKVKKIAELFAIKTDNKEQSKRIKDISKQVANAVLGYKTRFDTIALKEISKDELSDWNFKLSDIDADSKFEALMGNLDENEQAILLTIKELFNEVTLNGIVEDGNTLSESMINKYNDHRDDLKLLKEVIENHIDRKKAKELALAYDLYVNNRHGQLLQAKKKLGKIKPRSKEDFYKVVNKNLDDSRASKEIKKKIELDSFMPKQRTNANGVIPYQLQQLELDKIIENQSKYYPFLKEINPVSSHLKEAPYKLDELIRFRVPYYVGPLISPNESTKDIQTKKNQNFAWMIRKEEGRITPWNFDQKVDRIESANKFIKRMTTKDTYLFGEDVLPANSLLYQKFTVLNELNNIRINGKRISVDLKQEIYENLFKKHTTVTVKKLENYLKENHNLVKVEIKGLADEKKFNSGLTTYNRFKNLNIFDNQIDDLKYRNDFEKIIEWSTIFEDKSIYKEKLRSIDWLNEKQINALSNIRLQGWGRLSKKLLAQLHDHNGQTIIEQLWDSQNNFMQIVTQADFKDAIAKANQNLLVATSVEDILNNAYTSPANKKAIRQVIKVVDDIVKAASGKVPKQIAIEFTRDADENPKRSQTRGSKLQKVYKDLSTELASKTIAEELNEAIKDKKLVQDKYYLYFMQLGRDAYTGEPINIDEIQKYDIDHILPQSFIKDDALDNRVLVSRAVNNGKSDNVPVKLFGNEMAANLGMTIRKMWEEWKNIGLISKTKYNNLLTDPDHINKYKSAGFIRRQLVETSQIIKLVSTILQSRYPNTEIITVKAKYNHYLREKFDLYKSREVNDYHHAIDAYLSAICGNLLYQNYPNLRPFFVYGQYKKFSSDPDKEKAIFNKTRKFSFISQLLKNKSENSKEIAKKLKRAYQFKYMLVSRETETRDQEMFKMTVYPRFSHDTVKAPRNLIPKKMGMSPDIYGGYTNNSDAYMVIVRIDKKKGTEYKILGIPTRELVNLKKAEKEDHYKSYLKEILTPRILYNKNGKRDKKITSFEIVKSKIPYKQVIQDGDKKFMLGSSTYVYNAKQLTLSTESMKAITNNFDKDSDENDALIKAYDEILDKVDKYLPLFDINKFREKLHSGREKFIKLSLEDKKDTILKVLEGLHDNAVMTKIPTIGLSTPLGFMQFPNGVILSENAKLIYQSPTGLFKKSVKISDL

SEQ ID NO: 249 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 250 - protein, 1063 aa, Simonsiella muelleri
MEKFHYVLGLDLGIASVGWAAIEIDKETETSIGLLDCGVRTFERAEVPKTGDSLAKARREARSTRRLIRRRSHRLLRLKRLLKREIFRQPETFKDLPINAWQLRVKGLDSRLNEYEWAAVLLHLVKHRGYLSQRKSEMSETDSKSEMGRLLAGVAENHQLLQQEQYRTPAELALKKFVKHFRNKGGDYAHTFNRLDLQAELHLLFQKQRELGNPFTSPELERQVDDLLMTQRSALQGDAILKMLGHCGFEPEQFKAAKNTFSAERFIWLTKLNNLRIQDQGKERALTADERTKLLDEPYKKSKLTYAQVRKLLSLPQTAIFKGLRYDLEHDKKAENSTLMEMKSYHNIRQTLEKSGLKTEWQSIATQPEILDAIGTAFSIYKTDEDISHELKTCRLPENVLNELLKNINFDGFIQLSLTALRKILPLMEQGYRYDEACTQIYGNHHSGSLQQESKQFLPHIPIDDVRNPVVFRTLTQARKVVNAIIRRYGSPARVHIEMARELGKSKSDRDRIEKQQQKNKKERENAVAKFKEDFPDFVGEPRGKDILKMRLYEQQHGKCLYSGHDIDINRLNEKGYVEIDHALPFSRTWDDSQNNKVLVLGSENQNKRNQTPDEYLDGANNSQRWLEFQARVQTCHFSYGKKQRIQLAKLDDETEKGFLERNLNDTRYIARFMCQFVQENLYLTGKGKRLVFASNGGMTATLRNLWGLRKVREDNDRHHALDAIVVACSTASMQQKITKAFQRHESIEYVDTETGEVKFRIPQPWDFFRQEVMIRVFSDQPCEDLVEKLSARPEALHDNVTPLFVSRAPNRKMSGQGHLETIKSAKRLSEENSMVKKPLTTLKLKDIPEIVGYPSREPQLYAALKTRLETHDDDPIKAFAKPFYKPNKNGELGALVRSVRVKGVQNTGVMVHDGKGIADNATMVRVDVYTKAGKNYLVPVYVWQVAQGILPNRAVTSGKSEADWDLIDESFEFKFSLSRGDLVEMISNKGRIFGYYNGLDRANGSIGIREHDLEKSKGKDGVHRVGVKTATAFNKYHVDPLGKEIHRCSSEPRPTLKIKSKK

SEQ ID NO: 251 - protein, 1509 aa, Psychroflexus torquis
MKRILGLDLGTNSIGWSLIEHDFKNKQGQIEGLGVRIIPMSQEILGKFDAGQSISQTADRTKYRGVRRLYQRDNLRRERLHRVLKILDFLPKHYSESIDFQDKVGQFKPKQEVKLNYRKNEKNKHEFVFMNSFIEMVSEFKNAQPELFYNKGNGEETKIPYDWTLYYLRKKALTQQITKEELAWLILNFNQKRGYYQLRGEDIDEDKNKKYMQLKVNNLIDSGAKVKGKVLYNVIFDNGWKYEKQIVNKDEWEGRTKEFIITTKTLKNGNIKRTYKAVDSEIDWAAIKAKTEQDINKANKTVGEYIYESLLDNPSQKIRGKLVKTIERKFYKEEFEKLLSKQIELQPELFNESLYKACIKELYPRNENHQSNNKKQGFEYLFTEDIIFYQRPLKSQKSNISGCQFEHKIYKQKNKKTGKLELIKEPIKTISRSHPLFQEFRIWQWLQNLKIYNKEKIENGKLEDVTTQLLPNNEAYVTLFDFLNTKKELEQKQFIEYFVKKKLIDKKEKEHFRWNFVEDKKYPFSETRAQFLSRLAKVKGIKNTEDFLNKNTQVGSKENSPFIKRIEQLWHIIYSVSDLKEYEKALEKFAEKHNLEKDSFLKNFKKFPPFVSDYASYSKKAISKLLPIMRMGKYWSESAVPTQVKERSLSIMERVKVLPLKEGYSDKDLADLLSRVSDDDIPKQLIKSFISFKDKNPLKGLNTYQANYLVYGRHSETGDIQHWKTPEDIDRYLNNFKQHSLRNPIVEQVVMETLRVVRDIWEHYGNNEKDFFKEIHVELGREMKSPAGKREKLSQRNTENENTNHRIREVLKELMNDASVEGGVRDYSPSQQEILKLYEEGIYQNPNTNYLKVDEDEILKIRKKNNPTQKEIQRYKLWLEQGYISPYTGKIIPLTKLFTHEYQIEHIIPQSRYYDNSLGNKIICESEVNEDKDNKTAYEYLKVEKGSIVFGHKLLNLDEYEAHVNKYFKKNKTKLKNLLSEDIPEGFINRQLNDSRYISKLVKGLLSNIVRENGEQEATSKNLIPVTGVVTSKLKQDWGLNDKWNEIIAPRFKRLNKLTNSNDFGFWDNDINAFRIQVPDSLIKGFSKKRIDHRHHALDALVVACTSRNHTHYLSALNAENKNYSLRDKLVIKNENGDYTKTFQIPWQGFTIEAKNNLEKTVVSFKKNLRVINKTNNKFWSYKDENGNLNLGKDGKPKKKLRKQTKGYNWAIRKPLHKETVSGIYNINAPKNKIATSVRTLLTEIKNEKHLAKITDLRIRETILPNHLKHYLNNKGEANFSEAFSQGGIEDLNKKITTLNEGKKHQPIYRVKIFEVGSKFSISEDENSAKSKKYVEAAKGTNLFFAIYLDEENKKRNYETIPLNEVITHQKQVAGFPKSERLSVQPDSQKGTFLFTLSPNDLVYVPNNEELENRDLFNLGNLNVEQISRIYKFTDSSDKTCNFIPFQVSKLIFNLKKKEQKKLDVDFIIQNEFGLGSPQSKNQKSIDDVMIKEKCIKLKIDRLGNISKA

SEQ ID NO: 252 - protein, 1112 aa, Staphylococcus simulans
MLVGLKFKQSILFENMENAEDIKESATGSDAISLSDDYYENLSEFLTDEQLNFIESANTFFMGIMLDRILKGATSISAAKVRDYKIFKSQLKLIKDIVYQNKYDKYHEFFVTSKEDMRAYQENPDAKNFGKLSKFDQYLIHSKDQYAKLMKDLKGLVPKEYTEVLNLIDEQKFLVVQNTTDNASIPYQNNVFEAENILRNQQKYYPEITEEMIGKVINLISFRIPYYVGPLTNKNGQSDFAWMIRKSDEQTLPWNFDKVIDKSKSAEKFIRRMTSKCTYLLEEDVLPKHSLLYQEMEVLNELNNVQLRGENEPKHRIHRLDPKVKQFIYHNLFQKKKNVTHKDLITLLQNSEHRNTLNKTSGQKLKVFGTQNDSKFASKLSTYNDMKAILGSVENKRQMIEELVLWITIFEDKAILKQKIGEKYPNITEKQLNQIVKLNYSGWGRLSEKLLTKEVNGRSLIDLMYSTENNFMEIITDKTLGFDCFIKNSNKVKNAKISYKDVAELRTSPALKKGIWNAIKMVREISNLFGAPEKIIIEFATEDQAKGKRQKSRSELWDDLVKKNNLKRNKEFEGLFEELKAYPDLDFSNPKLWLYIHQNGKCMYTKKPIDLERLMSDTNNQLYEIDHILPRTFVKDDSINNKVLVIQSANQKKSGDKMPLEIFDNHVLVPFWKMLYENDLISSSKLSKLMKKEFNDLDKEGFIQRQLVETRQIISHVSDFLTEEYPSTTVVPMKANVVSELRRKFDIPKIRQLNDWHHAVDAYLNGFVYQAARVFYPKVNLFEFNFKWEKVREKWRQLGEFTENNKKREFFLFKRMENYVNEYGEGMISKLIFDLDNFKFNYSRKVESTESAFYKQSAFSPKNTTAQYDSDKNKTAIYKEMKNKRGIVVSYTYVKKDQELIGYGVFNETVFEYVNNADVDMNTRALKIVRKAFPKLDIKKAQYLFSINKGDALLVNGHPFLFVSAYERINGKQLEFDIAMQRKIKQALSPYNNMTEQEKVEFYNQFAEKVIEEFRNSIGLQSRDRKVNLIKNLFNNTEKSNDSMTQSILEVLKMTKVSAERSKELKIRWNGQTPNTFIDTKNNAEIQYKSITGLKTTKPKSIFKLAESKNEL

SEQ ID NO: 253 - protein, 1274 aa, Mycoplasma gallisept
MNINMNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKLEALNAKIDPKALSWILHDYLKNRGHFYEDNRDFNVYPTEELANYFDEFGYYKGIIDSKNDDDDKLEEGLTKYKFSNQHWLEEVKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVESEEKLEKDDHKWKLKGLKLNTNGKIQYNDLSSLAKFVHKLKQHLKLDFLLEDQYTPLDKINFLQSLYVYLGKHLRYSNRVDSANLKEFSDSSRLFERVLQEQKDGLFKLFEQTDKDDEKILTQTHSLSTKAMLLAITRMTNLDNDEDNQKNNDKGWNFEAIKNFDQKFIDITKTNNNLSLKQDKRYLDDQFINDAILSPGVKRILREATKVFNAILKQFSEEYDVTKVVIELARELSEEKELENTKNYKKLIKKNGDKISEGLKALGIAEDKIEEILKSPTKSYKVLLWLQQDHIDPYSQKEIAFDDILTKTEKTEIDHIIPYSISFDDSSSNKLLVLAESNQAKSNQTPYEFINSGKAEITWEVYEAYCHKFKNGDSSLLDSTQRSKKFAKMMKTDTSSKYDIGFLARNLNDTRYATIVFRDALKDYANNHLVEDKPMFKVVCINGGVTSFLRKNFDPKSWYAKKDRDKNIHHAVDASIISIFSNETKTLFNQLTKFADYKLFKNTDGSWKKIDPKTGVVSEVTDENWKQIRVRNQVSEIAKVIDKYIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMIRNKTAIIYNVEKDVVHRIKRLKILSSELKENKWSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLNDLIEIKNLIETEYKENVDSDPKKKKKASQILRSLSVILNDYILLDAKYNFDILGLSKNKIDEILNSKLDLDKIAK

SEQ ID NO: 254 - protein, 1122 aa, Artificial Sequence; identical to SEQ ID NO: 23
  synthetic sequence

SEQ ID NO: 255 - protein, 1236 aa, Artificial Sequence; identical to SEQ ID NO: 21
  synthetic sequence

SEQ ID NO: 256 - protein, 1059 aa, Artificial Sequence; identical to SEQ ID NO: 15
  synthetic sequence

SEQ ID NO: 257 - protein, 1166 aa, Artificial Sequence; identical to SEQ ID NO: 39
  synthetic sequence

SEQ ID NO: 258 - protein, 1149 aa, Artificial Sequence; identical to SEQ ID NO: 37
  synthetic sequence

SEQ ID NO: 259 - protein, 1314 aa, Artificial Sequence; identical to SEQ ID NO: 27
  synthetic sequence

SEQ ID NO: 260 - protein, 1064 aa, Artificial Sequence; identical to SEQ ID NO: 38
  synthetic sequence

SEQ ID NO: 261 - protein, 1401 aa, Artificial Sequence
  synthetic sequence
MDKKYSIGLDIGTNSVGWAVITDEYKVPSKKFKVLGNTDRHSIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLVDSTDKADLRLIYLALAHMIKFRGHFLIEGDLNPDNSDVDKLFIQLVQTYNQLFEENPINASGVDAKAILSARLSKSRRLENLIAQLPGEKKNGLFGNLIALSLGLTPNFKSNFDLAEDAKLQLSKDTYDDDLDNLLAQIGDQYADLFLAAKNLSDAILLSDILRVNTEITKAPLSASMIKRYDEHHQDLTLLKALVRQQLPEKYKEIFFDQSKNGYAGYIDGGASQEEFYKFIKPILEKMDGTEELLVKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSQILKEHPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKNPIDFLEAKGYKEVKKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGDAYPYDVPDYASLGSGSPKKKRKVEDPKKKRKVD

SEQ ID NO: 262 - protein, 1368 aa, Artificial Sequence
  synthetic sequence
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 263 - protein, 1368 aa, Artificial Sequence
  synthetic sequence
MDKKYSIGLDIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 264 - protein, 1368 aa, Artificial Sequence
  synthetic sequence
MDKKYSIGLAIGTNSVGWAVITDDYKVPSKKLKGLGNTDRHGIKKNLIGALLFDSGETAEATRLKRTARRRYTRRKNRICYLQEIFSNEMAKVDDSFFHRLEESFLVEEDKKHERHPIFGNIVDEVAYHEKYPTIYHLRKKLADSTDKVDLRLIYLALAHMIKFRGHFLIEGDLNPDNSDVDKLFIQLVQTYNQLFEENPINASRVDAKAILSARLSKSRRLENLIAQLPGEKKNGLFGNLIALSLGLTPNFKSNFDLAEDAKLQLSKDTYDDDLDNLLAQIGDQYADLFLAAKNLSDATLLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPYQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDIQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDAIVPQSFLKDDSIDNKVLTRSDKNRGKSDNVPSEEVVKKMKNYWRQLLNAKLITQRKFDNLTKAERGGLSELDKVGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDVRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELLGITIMERSSFEKDPIDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKYFDTTIDRKRYTSTKEVLDATLIHQSITGLYETRIDLSQLGGD

SEQ ID NO: 265 - protein, 240 aa, Acetobacter aceti
MANIAENLVFGIDLGIGSCGWAVLNQKAKDENIVALGSWCFDVPETDKERIPTNQIRRANRLLRRVIRRRRNRMAEIRRLFASKGMLDTADPDALAKISADPWEMRAKGLDYQLTPQEFAVALGHIAKRRGFKSAAKRVSTNAPSEDSKMLAALEKTKEQSAQYRTIGEMFARDPAYADRRRNRDGCFDRTMSREDLFKETQILFESQRRLGNFSATSETEQAFIDIAFRQKPMQDSERL

SEQ ID NO: 266 - protein, 400 aa, Acetobacter aceti
SFERFRLLCRLVNLRVTDGLEDRPLTPEELRLACEDAGKTRKLSVKKVRSLIGLRDDQRFTTIPPDQEQHDIAARTGDALTGTATFRAILGESFWRQLLPHPEQLDRAAWIISFHELTDTIISKLATIGLPSEVMELIRKALEDGKFSKFKGAASLSDKAARKLIPFLQEGLTYDKACQKAGYNHAASKFTHYDSIDTKAKFNSLMDDVRDSITNPVARKAISEGMKQVWAMRNQWGLPGAICIELARDVGNSAEKRREIESGIKKNTAQRERERQEAKEHLNQSDISSETLLRYRLWKEQGGRCCYTDQPITPSQLIASDNSVQVDHILPWSRFGDDSYLNKALCTAKANQEKKNRTPWEWIHNQKGVEAWNHFTAAVESRKETRGLKKRNFLLKSSKE

SEQ ID NO: 267 - protein, 376 aa, Acetobacter aceti
YAARVMAEAVRLLYPSGNRAEKGGVKRVFTRPGALTAALRHAWGVESLKKINGKRLNDDRHHALDAAVVAAVSEKEIQKLTKSFQICEQKGLARPMRDVPMPWEGFRHQLETAYADIRVARPERRRARGKGHDATIRQLREEKDGPVVYERRAISDLKLTDLERIKDPERNSAIISSLRTWIEKGKPADYPPQSPKGDEIRKIRVMSRNKPAVSVRGGTADRGEMTRVDVFTKMGKKGKPEWFLVPIYRHQVIDRIQWPQPPNQAAANGKSEKNWPTMGLEHEFRFSLYPRSYVQIVKRDGEIIEGYFAGLDRTVAAFSLLSSSDPTSIQRGIGAKTLESIRKYNVNRFGDISMVEQETRTWHGDVCISPDQPDSA

SEQ ID NO: 268 - protein, 1054 aa, Actinobacillus suis
MKLTPLNYILGLDLGIASVGWAVVEIDEQENPLGLIDVGVRTFDRAEVPKTGESLALARRLARSARRLVKRRADRIKKAKRLLKAENILLSADEHLPNDVWQLRVKGLDQKLERQEWAAVLLHLLKHRGYLSQRKNESKSENKELGALLSGVETNHQILQSAEYRTPAEIAVKKFHVEDGHIRNQRGAYTHTFSRLDLLAEMELLFQRQTDLGNPHTSAKLLENLTALLMWQKPALAGEAILKMLGKCTFEPTEYKAAKNSYSAERFVWLTKLNNLRILEQGAERALTDNERFALLDQPYEKAKFTYAQARTMLALPDEAIFKGVRYQGEDKKAVETKTILMEMKAYHQIRKALENADLKAEWNELKNNSELLDDIGTAFSLHKTDEDICRYLDGKLSESILNALLENLNFDKFIQLSLKALQQILPLMLQGQRYDEAVSAIYGDHYGKKSAEINRLLPTIPADEIRNPVVLRTLTQARKVINAVVRLYGSPARIHIETGREVGKSYQDRKKLEKQQEDNRKQRESAVKKFKEYFPNFVGEPKGKDILKMRLYELQQAKCLYSGKSLELHRLLEKGYVEVDHALPFSRTWDDSFNNKVLVLANENQNKGNLTPYEWLDGKNNSEHWQNFVARVQTSGFSHTKKQRILSHKLDEKGFIERNLNDTRYVARFLCNFIADNMLLTGKGKRKVFASNGQITALLRGRWGLQKVRDDNDRHHALDAVVVACSTVVMQQKITRFVRYEEGNVFSGERIDRETGEIIPLHFPSPWAFFRENVEIRIFSENPKLELENRLPDYPQYNHEFVQPLFVSRMPTRKMTGQGHMETVKSAKRLDEGLSVLKVPLTQLKLSDLERMVNREREVTLYESLKARLEQFGNDPAKAFAEPFHKKGGAVVKAVRVEQTQKSGVLVRDGNGVADNASMVRVDVFTKGGKYFLVPIYTWQVAKGILPNKAVTANVDEIDWLEMDESYQFIFTMYPNDLVKVKLKKEEFFGYYGGLDRATGAIVIKEHDLEKSKGKQGIYRIGVKLALSFEKYQVDELGKNIRPCRPTKRQHVR

SEQ ID NO: 269 - protein, 239 aa, Actinobacillus ureae
MEIRIFSENPKLGLENRLPGYPQYNHEFVQPLFVSRMPTRKMTGKGHMETVKSAKRLDEGLSVLKVPLTQLKLSDLERMVNREREDALYQSLKAHLEQFGNDPAKAFAEPFHKKGGTVVKAVRVEQTQKSGVLVRDGNGVADNTSMVRVDVFTKAGKYFLVPIYKWQVAKRILPNKAVTAGVDEIDWLEMDSSYQFIFTMYANDLVKVKLKKRSILGLLRWFRSCNWGYCYQRTRFREI

SEQ ID NO: 270 - protein, 400 aa, Actinobacillus ureae
MKLTPLNYILGLDLGIASVGWAVVEIDEQENPLGLIDVGVRTFDRAEVAKTGESLALARRLARSSRRLVKRRADRIKKAKRLLKAENLLLSADEILPNDVWQLRVKGLDQKLERQEWAAVLLHILKHRGYLSQRKNESKSENKELGALLSGVATNHQLLQTAEYRTPAEITVKKFQAEENGHGHIRNQRGDYSHTFDRKDLLAEMKLLFQRQAELGNPHTSEKLLENLTTLLLWQKPALAGEAILKMLGKCTFEPAEYKAAKNSYSAERFVWLTKLNNLRILENGIERALTDNERFTLLDQPYEKAKLTYAQARTMLALSDEAIFKGVRYQGEDKKAAEKVALIEMKGYQHIRKALEGAGLKAEWNELKNNSELLDDIGTAFSLYFSISNLPTEIAYFTP

SEQ ID NO: 271 - protein, 1113 aa, Actinomyces georgiae
MSASSQNVERIRYKVGIDVGLRSIGFCAVQVDADDRPVKLLNTVVHVHDAGVSPADAKKADTRKLVSGVARRTRRLYRTRKRRLVDLDRQLDGLGWPLVDPARFADPREPWFAREKLVSGRVDDADERKELLSVALRHIAHHRGWRNPYSTVESLQADAPPSEFLQGLNQRVSEKLGTELDPGLTQGQLVAKLLHRFPNAKIRGPEGILRGKLHQSDNAGELRLICRTQGLDCHITEELVRLVFQAKSPKANKEMRKRIGRDQLPGQGAHIRAEKAHPVFQRFRIVAVLANLRIREAHVDRRLTAEEMRTLTDFLLGLAGSEQPTWEELADNLNIERHQLRGTAKASVDGAPALRFPPIDATTDRIYASKLKWLAEWWRQADEERRGYMVDALSNSGGSEDEPYLDDEIAEMLEQASEEDQAKLDSLHLPGGRASYCLDTLRRLTDAMLGGGLDLFEARKAVFHVDDDWAPPTDPIGAPVGNPPVDRVLKHVARWLEAATGRWGAPQTINIEHVREGLGSEKAARELTRMNDRRRRNNQKLVEEMGEKLGMSGRIRRSDRMRYEAIRRQNCECLYCGQPITYQTMEMDHIVPRAGAASTNSRSNLAAVCRRCNHQKGKLPFAVWAESQDSPAEVRLQDAVQRVRHWLRDAGMGQKELQALRVQVIARLKSKRPDEEFDGRSMESIAWMANELRARVEAQYRGSGTTVRVYRGALTAEARKASGFEGRVNLIGGRGKDRFDRRHHAMDALVIALMNQSVAQTLALRLNMRDSQWLTQSEQTWRQFHGAPGEAARKWEAWDRDMRDASDLFNLALDGGRIPITENVRLRVGNGRVHEDGVIRFKPEYEVKGKTIKGGEARLLGDSLPSEQIDRAETPALWTALTRLPEYDRKSGLPENPDRVIRVNGAVVQATDRIRFFGTPASVAVRGGYAKLGESIHHARIYRINGKTPKYAMIRVYTIDLMRLNHEDIFTAVLKPSTISMRCAEKKLKYAIAEGNAEQIGWLVEGDQLELDAAAYAKGVGADLMREYPMATCWRVAGFPDEAKLRLRPVLLAAEGMGEDAPKFMREVLENQGWRPAVNALLSPGSVRVVRRNVLGEPRFKSSGHLPTTVDLV

SEQ ID NO: 272 - protein, 1101 aa, Actinomyces naeslundii
MWYASLMSAHHLRVGIDVGTHSVGLATLRVDDHGTPIELLSALSHIHDSGVGKEGKKDHDTRKKLSGIARRARRLLHHRRTQLQQLDEVLRDLGFPIPTPGEFLDLNEQTDPYRVWRVRARLVEEKLPEELRGPAISMAVRHIARHRGWRNPYSKVESLLSPAEESPFMKALRERILATTGEVLDDGITPGQAMAQVALTHNISMRGPEGILGKLHQSDNANEIRKICARQGVSPDVCKQLLRAVFKADSPRGSAVSRVAPDPLPGQGSFRRAPKCDPEFQRFRIISIVANLRISETKGENRPLTADERRHVVTFLTEDSQADLTWVDVAEKLGVHRRDLRGTAVHTDDGERSAARPPIDATDRIMRQTKISSLKTWWEEADSEQRGAMIRYLYEDPTDSECAEIIAELPEEDQAKLDSLHLPAGRAAYSRESLTALSDHMLATTDDLHEARKRLFGVDDSWAPPAEAINAPVGNPSVDRTLKIVGRYLSAVESMWGTPEVIHVEHVRDGFTSERMADERDKANRRRYNDNQEAMKKIQRDYGKEGYISRGDIVRLDALELQGCACLYCGTTIGYHTCQLDHIVPQAGPGSNNRRGNLVAVCERCNRSKSNTPFAVWAQKCGIPHVGVKEAIGRVRGWRKQTPNTSSEDLTRLKKEVIARLRRTQEDPEIDERSMESVAWMANELHHRIAAAYPETTVMVYRGSITAAARKAAGIDSRINLIGEKGRKDRIDRRHHAVDASVVALMEASVAKTLAERSSLRGEQRLTGKEQTWKQYTGSTVGAREHFEMWRGHMLHLTELFNERLAEDKVYVTQNIRLRLSDGNAHTVNPSKLVSHRLGDGLTVQQIDRACTPALWCALTREKDFDEKNGLPAREDRAIRVHGHEIKSSDYIQVFSKRKKTDSDRDETPFGAIAVRGGFVEIGPSIHHARIYRVEGKKPVYAMLRVFTHDLLSQRHGDLFSAVIPPQSISMRCAEPKLRKAITTGNATYLGWVVVGDELEINVDSFTKYAIGRFLEDFPNTTRWRICGYDTNSKLTLKPIVLAAEGLENPSSAVNEIVELKGWRVAINVLTKVHPTVVRRDALGRPRYSSRSNLPTSWTIE

SEQ ID NO: 273 - protein, 1181 aa, Actinomyces sp.
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 274 - protein, 1120 aa, Actinomyces sp.
MNAMKQYNAGIDVGINSVGFAAIEVDSKGLPLNILNNMVVLHDSGVDPGTAKTGATRLANSGTARRTRKLIARRRKRLQKLDRYIEVQGWPLVDFSSLPDPYTPWKIRAKLTQDRLEGEEQGRGLSIALRHMARHRGWRNPYEGVESLHSPKEASKQFKDLKDRVTKVSGVIFDEDATPAEVVCDIGLSPKQRLRSAPSAKYKEGATLADEPVGGKSKEGLLGGKLMQSDNANELRKIGIVQGLSNEKVNEIIDQVFASESPKGQAGKRAKKDELPGQEQYVRALRAHLAFQRFRIVAAVANLRILEAEPKHERLLSQSEKDKVIEFLMSADGDDGVTWSDVAEELGIERECLSGTAKRGADGERPSSFPPTNSTNISIVRSKVKPLIEWWRKASDDEQATLVTALSNADELTDDQPSAETVRQFLSSPDEQSQEKIDKISLPKGRAAYSVNSLERLTRRMLKDSVDLFEARKREFGVDNNWTPTPDSIGEPVGNPAVDRVLKIVNRWLLAVTRKWGPPKVVNIEHVRVGFTSAAQTRKYEEENKTNRERNLAILEELRDKFGTSGKIRREDITRFAALRRQNCQCAYCGEAITFFDCEMDHIVPRKGPGSTNTRNNLVAICERCNKSKSNMPFSLWAQNCDIPGVSVEAVIDRVRTWIKDPELNPKQYNNFKKDVIERLRKTVDDDAIDNRSIESVAWMATELADRIGSHFRTAGANTKVRVYRGWLTSEARKASGFEGKINLIGGRGKTRLDRRHHAMDAATIALMRQSVAQTLVERASIRESDRLRRVVSSSWKDYRGADRDKQFSYGSWLNSMNALAELFNRAIDADGIPVTQNLRLRLGNGEAHDATIRSLEKKRVGASWTIGEIDRASTPQLWLALTRQEDFDQNDGLPANASRELRVKNHWFHAEENVTLFPTKSAAIAVRGGYAEIGNTIHHARLYKLPGKKLTYGMIRVFAIDLLCAWHTDLFSSPLLPESISLRTAETKVRRAVEDGAAMYIGWLVDGDEIVLDPETKAFKSNKIGEYLCEFPGTKRWKVDGFPDKEKLRLRPLQLAGEGLPEDVSAGTEEILGPKGNGWRVAINALFKSSQLVVVRRTALGMVRKLSRRHLPLTTRLRG

SEQ ID NO: 275 - protein, 1095 aa, Actinomyces sp.
MPAHHLRVGIDVGTHSVGLATLRVDDQGTPIELLSALSHIHDSGIGKEGQKDHDTRKKLSGVARRTRHLLRNRRERLQQLDKVLVDLGFPIPKPEEYPDLSERTDPYRVWRVRARLVEETLPEELRGPAISMAVRHIARHRGWRNPYSKVESLLSPAEESSFMKALRKRIMTKTGEVLDDDITPGQAMAQVALTHKIYMRGPEGILGKLHQSDNANEIRKICARQGISSDVCKQLLRAVFKAESPRGSAVSRVAPDPLPGQGSFRRAPKCDPEFQRFRIISIVANLRISETKGENRPLTVDERRQVVAFLMEDSQADLTWVDVAEKLRVSRQALRGTAMLTADGERSAAQPPIDVTDQIMRKTKISALKTWWDKADAERRGAMVRYLYEGLEDSECAEVIAKLPEKDHAKLDSLHLPAGRAAYSRESLTALSDHMLETTNDLHEARKRLFGVDDSWAPPAEPVGAPVGNPSVDRTLKIVARYLSAVESIWGTPEVIHVEHVRDGFTSERTAEERDKANRSRHNDNQKAIEKIQHDYGKEGYISRGDIVRFHALKLQGSACLYCGTTIGYHTCQLDHIVPQAGPGSNNRRGNLVAVCERCNHSKSNTPFAVWAQKCGIPHVGVKEAISRVNGWVEHNHSTSSGDLTRLKKEVIARLRRTQKDPEIDERSMESVAWMANELHHRIAAAYPETTVMVYRGSITAAARKAASIESRINLIGEKGRKDRLDRRHHAVDASVVALMEPSVAKTLAERSSLRGEQRLTGQEQTWKQYTGLTVGARERFEAWRGHMHRLTELFNESLAADEVYVTQNIRLRLSDGSAHTVKASKLVSHRLGDGLTVQQIDRACTPALWCALTREIDFDEKNGLPAREDRVIRVHGQEISSADCIQVFSKRKKTKSDRDEAPFGAIAVRGGFVEIGSSIHHARIYRIEGEKPAYAMLRVFTHDLLSQRHGDLFSAVIPPQSISMRCAATELRQAISEGRATYLGWIVSGDELHIPVETFTTHKIGSFLKDYPNTTRWRICGYDSETMLILKPRILSAEGLNNSSDIAEYVIKNKGWRVAINKLAKVHPTVVRRDALGRPRHSSRSNLPVTWSIE

SEQ ID NO: 276 - protein, 1144 aa, Actinomyces sp.
MSMIDSSENVPGIRYRVGIDVGLKSIGFCAVEVDRNDQPVRMLNSMVFIHDAGVDPNENKAAKSRKLTAGVARRTRRLYRTRHQRLVNLDRVLSKEFGWPLPDLTSFKDPREPWHVRAGLLEGYIADDEKRKEALSIALRHIARHRGWRNPYAKVETLLQPSEPSDFLKGLNDRISEELGRAFPADATPGQLVDTYLAHPDYVGRAGTPKLRGPQGILAGKLHQSDNAQEIRGICDVQRIEPAERDRLIRVVFEAKSPKGSAKERGLVGYDELPGQGRHVRAEKAHPAFQLFRMVSVLANLRIREGREERPLTPDELEDLVDFINQVSLKQEVTWQDLADKLRIERADLRGTAKASFDGSPVLRNPPTDVTTEKIMACKVKWLKEWWKEADDEQRGYMVDAFSNSGGSEDGTDVNDEVAELLEQATEDDQLEFEKISLPQGRAAYSLDSLRRLTDRMLRDGVDLHTARRLEFNVGDDWKPAVEPIGAPTGNPAVDRVLKQVSRWLHAATERWGEPTVINIEHARDGLGSERVARELMRENEKRRKANASAVAEMAAKLKLSGKVHRSDQIRYFALQRQNCQCLYCGAPITYTTAEMDHIVPRADGSSTNDRSNLAAVCRTCNHMKGKIPFAVWASSDKANQGVSLTGALERVNMWQRDSGMSPRQLKQLQREVCARLKSKKPDQEFDGRSMESVAWMAVELRTRIEGFYRSRDEESVPSVGVYRGQLTAEARRASGFESRVNLIGGRGKTRFDRRHHAMDALVIALMNPSVSRTLALRLNMRDAQRLTGVEETWKHFYGKPGEASKRFESWRESMLRGVELFNIALSDNAIPFVENIRLRVGSSVIHDATVHSFCPPKTPDGKQIITKGYGEQHSLGSAMPVELIDRAETPALWTALTRCPDFDPKKGLPENPQRTISVNGTRVGPTELVNFFEFSKSGPKACLKVRGGYVDLSGAIHHARIYRIAGKKTAYAMIRVFQVDLLRLKDHDVFTTPLKPSTISMRTAEPKIREALANGTATQIGWLVEGDELVIDTSKYSGGFIGEVLARYPEATSWRVAGFMTPAKLRIKPILLSKEGFVDETQAALLGVEVTSEAIQKTVDRPGWLPAVNVLFGAGGVRVIRRNCLGEERYHSSASLPVSMTLE

SEQ ID NO: 277 - protein, 1103 aa, Actinomyces sp.
MTKINDDLRYRVGIDVGLKSIGFCAVEVDENDQPLRLLNSMVFVHDAGVDPNENKAAKSRKLTAGVARRTQRGTAQNRRRLAELDRALSEELNWPLPNLEDFEDSYEPWHTRAELVEHYIKDDAERAEALAIAIRHIARHRGWRNPYLSVDSLLTPQEPSKFLRGLNERVTQALGREFPADATPGQLICAYIDSPKYAETQGIRGDSGILSGKLHQFDNVGEIRKICEVQRLDHDVFKLLVRKVFFAKSPRGSAAGLVGHDQIPGQGKYIRAEKAHPDFQLFRIVAVLTNLRIREGKAERCLTPDELRGLVDYILEVQLKQQVTWADLADNLGIERTDLRGTARASFDGSPALRFPPTDVTAEKIMASKVKWLKDWWDKADSERRGFMVDALSNSGGSTGDNDIDDEVAALLEAATEDEQAELEKIQLPQGRAAYSLDSLRRLTKRMLEEGVDLHTARKEEFNVDDDWRPEPEPIEAPVGNPAVDRVLKQVARWLNMATDRWGVPDVINIEHTRDGLGSEKVARELLRESQKRQDLNQKDMDKMIRELGISGKARRSSLIKYQAIQRQNSMCLYCGTEIGFETAEMDHIVPRALSGSTNDRSNLAAVCRACNHQKGAVPFAVWATSGEAHAGVSLEDAIKRVRLWQKGPGMSPKQHKAFQNEVISRLKSRKPDEEFDGRSMESVAWMAVELRTRIDGYYRKVNSDSVPKVGIYRGQLTAEARKASGFENRVNLIGGKGKTRFDRRHHAMDALVIAMMNQSVSQTLALRVNMRESQRITGQEETWKNFYGKPGQASERFEKWREGMLRAVELFNIELAKNAIPFHENVRLRVGSSKVHDDTVRKFIHAKLGEALSVAMIDCAETPALWTALTRLPDFDPKDGLPEDLSREIYIHSRKITADEQLNFFNSPSACLKVRGGYVEIGSSIHHARVYRIDGKKTTYSMVRVFATDLVKMTHEDVFTTPLKPSTISMRTADPKIRKALADGTATQIGWLVEGDELQLETDKYSGGLIGEVLAEYPQLTSWRVAGFYGVTQLRLRPYMLAAEGIPSDASESLRKVIEGKGWLPAINALLSSGCVKVVRRNCLGEPRFNAKSSLPVSQLLR

SEQ ID NO: 278 - protein, 1114 aa, Actinomyces turicensis
MQFHFYMVYVTMKGMNDKDASQQLRYRVGIDVGTHSIGFCAVEVDESGMPIQLLNSMVHKHDSGIDPGGNDTATTRLAEAGVARRTRRLIRRRKKRLQELDAFIEECGWPLVDLATITDARSPWRIRAHLATEHIDDEAEQGKLLSIALRHMARHRGWRSPYARISSLHIQADPSEQLKALAQRVSEKTGISLTADQTPAQLISVYLDVFETGKLRGPEGILGGKLMQSDNANELRRIATVQGLDNDLLKKIIGFVFAAESPKGSAAKRVGKDVLPGAHGLRAEKAHPAFQQFRIVSIVQNLRIKEGTGLRALTSEETEIVVDFLNQAGLTEAPTWEEVADNLEIPRSHLKGTATEGFDGIAPSTRPPFDVTSQKILNGKLKKLSAWWKDADYDHRCAMVNALSNVGSDDEGSLADDDVREFLSDFTDEELEALDKVELPGGRAAYSVDSLEKLTNTMLSEGCDLHSARKIAFGVDDSWTPPAEPIGQPVGNPAVDRVLKQVARWISAATNQWGTPESVNIEHVRDALGSEKASREYQRSLQTRRIRNEKLFAEMRERLDIGGKPRRSELTRYLALQRQNCQCLYCGMPITYTDAEMDHIVPRKGAASTNTRENFAAVCRACNHQKSNLPFAVWAEKTERPGVSVKEAYKRVSDMRIEPGMNGRQMNEFRKAIRLRLTTKHADAEIDGRSLESVAWMANELRHRIEGFYRSAENDVTVRVFRGAVTAEGRRASGFESRVNLIGGKGKTRLDRRHHAMDALTIALMEPGIAQTIALRMNMRESQRVLGEQETWKSFTGGSDTARKRWEHWCEEMLRASELFNVFLAEDRIPICQNKRLRLGSSAVHKAIVQPFEASDKRIVSDAMPVELIDRASTPALWTALTRDPDFDPKEGLPANPSRTIRLHDKRLGPNETVEFFPTAAACLAIRGGYCEIGAGIHHARIFRISGKKTTYAMLRVYQCDLVRFQKENLLTVELPANTISVRTAVPKLREALAHGTAEQIGWLVVGDELKIDLSGFTTGQIETFNETYPQATRWEVTGFPTKTQLRLKPLLIASEGLADDVPDDIVKIVKGPGWWPAIDKLLKIGNVVLYRRDTHGKPRVVSHRSLPLSSKLQ

SEQ ID NO: 279 - protein, 1113 aa, Alcanivorax sp.
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 280 - protein, 1146 aa, Alicyclobacillus hesperidum
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 281 - protein, 1552 aa, Anaerophaga sp.
MFSQRNNPYCELLQNVKQLYKEKFGKTNQVDNSIIYGFMKRILGLDLGTNSIGWALVENDENDRKGKIIGMGSRIIPMDMSELDNFNKGASISKTAERTRLRMTRRLRERHLLRRARLHRILNIMGFLPEHYRNSIDFIDKKGCFFEGQEPKIAYKPDKNSEQFCFLFTSSFHEMLEDFRKFQPELIQNRKKVPYDWTIYYLRKKALTQKISKEELAWIILNFNTKRGYYHLRGEDEDNQDNKKIKEFRALKVVNVTEREGANSSGKKWYDMELENGWVYSRQSNLPPNLEGKTIELIVSYTLDNNGNIKKDKNGKEKYSLSMPGEEDWNLVKIKTENDLKTSKKSVGEYIYDHLLKNPDQKIRGKLISTIERKFYKEELSRILKTQMNFYEELKNRELYQKCVEELYPNNKSHQQTLLQKDFIHLIVEDIIFYQRPLKSKRAFVNNCPLEYRVYVDKKSGELIKSGVKCIPKSHPLFQEFRLWQYVRNLRIYERERMVNGRLMVNVDVTNELLPDEEHIVRLFDLLNDRKSFKQDDVLRFVGIKSPKDRKRYSWNYPEDKELPGNETRHLILAWLKKVDGVPEDWLDPEKLKALWHLLYSVTDREEIIKGLHSFAKKYELPDTFVEHFKKIPRLEREYGSFSEKAIKKLLPLMRMGKYWKAEEIPADLLEKAQKIIDAEADDRISDEVREKLLHLKDISQLKGLPLWQASYLVYGRHSETGEVVKWRTSEDLEKYILQFKQHSLRNPVVEQVILEALRVVKDIWEHYGEGKEGFFNEIHVEIGRELKNPADKRKKITSQIQENENTNLRIKALLEELFNDPSVKNVRPYSPAQQEILRIYEDGVLNGQKEIPDDILKISKMARPSKSQLVKYKLWLEQKYRSPYTGEIIPLSQLFTSAYEIEHIIPQARYFDDSFSNKVICEAEVNREKGHQLAFEFITKRGGDEIELNFGKKVTILNVEEYQKFVKDHYGRSLRSLSKMRKLLMEDIPDDFIDRQLNDSRYISKVVRNLLSNIVRAEDENSLVSKHLITCTGGVTTRLKHEWGLNDVWNELITPRFVRLNKMGKEKFGEWINKKGKQVFQIQMPLELQKGFNKKRIDHRHHALDALVVACASRSHVNYLNNDSARANASETRYDLRNKLCYKDKTDSNGNYRWKFYKPWESFTEEAKNRLAGTVVSFKSNRRIMTRSSNRYFKWVDTSEGKKKKLVRQIKGDNQAIRKPLHKDTVLGKVSLRKEKKVSLSKAIDLWESIVDKPLKKRIQSLREQGYDKKLLLKYFKDRNNQFNGQDISRVNIYFFDNNLAARRVTLDASFNSEKRIDGITDSGIKKILYAHLQNEKYHGKKDEKGNEISPYELAFSPEGLEEMNANIKKLNGGKPHCPIYKVRLAETIGEKFKLGEKGNKNKKYVEAAKGTNLFFAVYVDEKGVRSFETIPFSVALERRKQKLAVVPEENENKEKLLFYLSPNDLVYVPDEDEKLIDYRQLSINPTRIYKMVSSSGTQCFFIPHFVASPIVQTMELGPNNKSERAWDGQMIKNVCYKLSVDRLGNVKIEK

SEQ ID NO: 282 - protein, 1515 aa, Anaerophaga thermohalophila
MKRILGLDLGTNSIGWALVESDEEQKSGKIQGIGSRIIPMDQNELDNFNKGNTVSQTAERTRLRMVRRLRERHLLRRERLHRVLKEIGFLPEHYLEQIDFTEKPGGFLPGKEPKIAYKPDNFKDKYDFLFQDSYHEMLSDFQDKNPEFIQKRKKVPQDWTIYYLRKKALTAKITKEELAWIILNFNQKRGYYQLRGEDEDVAKNTKKEEFHALKVVKVKEREDSEGASGKWYDIELENGWVYPRQSNIRPDWEGKILELIVTYNLDKDGNIKTDKEGNEKRSFRMPNKDDWTLRKKRTENEIEKSGKTVGEYIYDNLLDAPDLKIRGKLVSTIERKYYRSELEQILTAQKKYHPELSNSELFNKCISNLYPNNDIHRKALLSKDFVHLIINDIIFYQRPLKSKRSTVSNCPLEYRVYVDKVTGEKKKVPLKCIPKSHPLYQEFRLWQYVKNLRLFEKERFENGRLLTNVDVTEQFLPDEDKYVELFEFLNGRKTFKQDDILKFAGIKSAKDRVKYYWNYPQEKEYPGNETRYLIESRLKKIENVPDEWLNYEKIEELWHLLYSVTDKVEIEKGLQSFAAKYQLPDLFVEVFKGFPRMEREYGAFSKKAIKKLLPLMRMGKYWKLENINPDLIEKVQKIIDGEADDNINDGIRERFSEINEMSDLRGMPLWKASYLVYGRHSEAAEVIRWRTSADLDQYIKDFKQHALRNPIVEQVVLEALRVVKDVWNYFGEGREKFFDEIHVEIGRDLKNPADKRQKIANQIQENENTNLRIKALLVELFNDPEVQNVRPYSPVQQQLLKIYEDGVLNAERDIPDDIQKISRMANPTRNQLIRYKLWLEQKYRSPYTGEIIPLNKLFTSEYEVEHIIPRARYFDDSFSNKIISEAEVNRKKDRMLAFEFIKKLGGSTIDLNYGKKVSVLTVEEYQQFVKDHYGINPHSRLKMQKLLMDEIPESFIERQLNDSRYISKMVRNLLSNIVREENENSPVAKQLITCSGSITNTLKQEWGLNDVWNTIITPRFERLNKMGEQKYGEWVNKEGKPVFQIQMPLELQKGFNKKRIDHRHHALDALIVASATRSHVNYLSNEAAKTNAKDTRFDLRNRLCYKEKRGQNRNFTWRFYKPWNTFTEDAKNALNDIVVSFKSNHRVINKSTNRYFKWENLPGGMKKKRLVRQEKGDNWAIRQSLHKDTVLGKVSLRKVKPVSLSVALDSWNNIVDKALKKKIRSLKDQGYDKKLMLKYFKDRRNEYNGENISRVNVYYFDEEMAARRVDLDTSFNSEKRIEGITDSGIKKIIYAHLKNEKYHGQKDDKGKDISPYELAFSPEGIAEMNANIKQLNGGKPHCPIYKVRLAEPVGEKFQLGETGNKTEKLVEVAKGTNLFFGVYANDEGVRSFATVPFYLAVEREKQGLPAVPQENENGDQLLFWLSPNDLVYVPSEEDAHFANPKQIELDNSRIYKMVSSTGTQCFFIPHFVATPIVQTIELGPNNKSERAWDGQMIKKVCYKLSVDRLGNVEIE

SEQ ID NO: 283 - protein, 333 aa, Bacillus cereus
MMNPNNFTKEDFWRTIILYGLNQATYKIALGQSLIRFSEQQRNVVSMNELAEDFFDMYLERLKNGKPQLATPNRQTAMERIINSYNIGRLTRSQAIEKVEREAFNDVIDRFHTVDSLQVPMKFYEKTDKGIVIFDNVFEIFSDNNNFELRNELDARWDLLESAFEIKRTDSQLVNDIRKLYLANGYERTDITKNRSVLNGYQSNVCFYCGELMSDDDVHVDHVIPRQLINHDDIWNLVLSHGFCNQQKSDNLPDVNYIEKLIERNEYFIKSNHPISNKLKERLGNTPRRRRTTIDRIYEHAKLVLAPWKGIYGYNPATDPFYKTFIRNIVLSK

SEQ ID NO: 284 - protein, 1068 aa, Bacillus cereus
MRYVLGLDIGIASCGWAVINQEKERIEDLGVRIFDKAENPKDGKSLAAPRRDARSTRRTLRRKKHRMQRIKILLVKQGLLFKTELNHLYESATEFDVWNLRLDALERKLHPKEFARVLIHLAKRRGFKSNRKETTLSENGQILESISENQQIMEQQNYRTVGEMILKDKKFENHKRNKDGTYIGTVTRQQLQDEIQMIFHTQRLYKNDYATEEFESSYLEIWASQRPYASKDQIEKMIGYCTLEPKEKRTPKASWSFQYFVALQTINNLRLISKDKIEELSFEEKKQIMNLALEKPIVKYIDIRKLLSIPNDFQFNSLSYSADTVDTTLENKRCIELKEYHSINKVYKQVYGKNTPNLLPIDYDTIAYGLTIFKDDKDILEYLQNKYVNAKGKPIKNLAKKTYDDTFIQALLNLNFTKMGHLSFKALKNIIPFLEEGLSYDKACEKAGYNFKGTSYTERTKYLPVIPQNTNPVVHRALSQTRKVINAIIKKYGSPNAIHIETARELSKTFQERKEIDSRYQDNSKKNEHAIHKLKELGNINPSGINIVKFKLWSEQDGRCMYSGKYIEPHRLFEEGYTEVDHILPYSRSLDDSYNNKILTLGTENQRKGNKTPYEYMGNTSIWDEFETRVQSNKKINFKKQQKLLLQNFSYAREQEFIERNLNDTRYATIYLTSLIQQHLIFSESSSKKKVRTVSGIITSHLRSRWGFNKDRKEGHIHHALDAVIVAVTSNHMIQRVTKYYKLKELNKNLQAKQLPFPEPWEGFRLELEARISPNTQQYLKGIHFKNYADVNLSDIKPIFVSRMPKRSITGELHQETIRKFLGYNEKGKVLTAIKTKLEDIPFDANGDFPMYGKETDLYTYNAIKERYLSHEKDKRKSFQEPLYKPTKSGEIGPLIKSIKIMDTRTIVNPVNQGKGVVYNSKIARTDVFKKEDKYYLIPIYTIDLLKNILPHKAITAGKGYEDWTTIDSSFTFLFSLFPNDLIQIVPSKNKTIKARTTVSKKEILLPSLTGYFKGVHSGTAGITVETHDGSVIANVGSKQLLLFEKYQVDVLGHYTKIKEEKRMGMAI

SEQ ID NO: 285 - protein, 1078 aa, Bacillus cereus
MRYVLGLDIGIASCGWAVINQEKERIEDLGVRIFDKAENPKDGKSLAAPRRDARSTRRTLRRKKHRMQRIKVLLVKHGLLSKTELDHLYESATEVDVWNLRLDALERKLYPKEFARILIHLAKRRGFKSNRKETTLSENGQILESISENQQIMEKQNYRTVGEMILKDKKFENHKRNKNGTYVGTVTRQQLQDEIQMIFHAQRLYKNDYATEEFESSYLEIWASQRPYASKDQIEKMIGYCTLEPKEKRAPKASWSFQYFVALQTINNLRLISKDRIEELSFEEKKQIMNLALEKSIVKYIDIRKLLSVPNEFQFNSLSYSADTVDTAVESRKCIELKEYHSINKVYKQIYGENALNLLPKYYDTIAYGLTIFKDDKDILEYLQNKYVNAKGKPISNFANKTYDDTFIQALLNLNFTKMGHLSFKALKNIIPFLEEGLSYDKACEKAGYNFKGTSYTEQTKYLPVIPQNTNPVVHRALSQTRKVINAIIKKYGSPNAIHIETARELSKTFQERKEIDSMYQDNSKKNEHAIHKLKELGNINPSGINIVKFKLWNEQDGRCMYSGKYIEPHRLFEEGYTEVDHILPYSRSLDDSYNNKTLTLGTENQRKGNKIPYEYMGNTSIWNDFETRVQSNKKINKKKQQKLLLQHFSYAREQEFIERNLNDTRYATIYLSSLIQQHLIFSESSRKKKVHTVSGIITSHLRSRWGFNKDRKEGHIHHALDAVIVAVTSDHMIQRVTKYYKLKELNRNLQAKRMPFPEPWEGFRLELEARISPNTQQYLKGLRFKNYADVNLSEIKSIFVSRMPKHSITGELHQETIRKFIGYNEKGKVLTAIKTKLEDIPFDANGDFPMYGKESDLYTYNAIKERYLSHKKDKRKSFQEPLYKPTKSGGIGPLIKSIKIMDTRTIVNPVNQGKGVVYNSKIARTDVFKKEEKYYLIPIYTIDLMKNILPQKAITAGKGYEDWTTIDPSFTFLFSLFPNDLIQIVPSKNKTIKARTTVSKKEVLLPSLTGYFKGVHSGTAGITVETHDGSVIANVGSKQLLLIEKYQVDVLGNYTKIKEEKRIGLTTYNDNKKIAAC

SEQ ID NO: 286 - protein, 1088 aa, Bacillus smithii
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 287 - protein, 1069 aa, Bacillus thuringiensis
MNYDIGLRIGITSCGWSIINKDLERIEDLGVRVFEKAENPDGTASAAPRREARKSRRKHRRKKHRIERIKRLIVQHDLLSKKELDSLYLSPFNIDVWNLRVEALERKLDNREFARVLIHLVQRRGFQTIRKSVEIQEEGKLLENVSENERIMKVNGYKTVGEMFSKHEKFTHHKRNKDGSYTSVVTRSLLLKEIKTIFNSQRILGNVFSTQKLESDYLYIWGSQRPTLTYEQLMSMVGNCIYEKKEKRAPKTSWAFQYFSLLQKINKLKVSDDNTLRKLSKEERDIVIELAFKKKNVSFVDIRKALKLNDNTKFNHLTYSHVVETKKVEKATFIELKGYHLIKKQLKDRNVELTQELQPKDYDAIAAASTFFKNDIEFRDYLRNQYLDSNGKRKSNIANKVFEDKVIAAVFELNFSKVCHLSFKSLYKLIPHLEKGLDYKEAILCAGYNFRDENKRDKKLFLPVIQQETNPVVHRALTQARKVINAIIREYGSPNTIRFVVANDLAKTYKQRKELESTLKKNRAENEKIKTKLLSMGIINPTGMDIVKYKLWYEQSGICLYTGRQMELSSLFKPGYSIVNHIIPYNRSFDDTYHNRVLTLTETKYEKGNKIPFEYFGAEETCWNEYEKRVSTSKKIHDKKREKLLIRNFDIEYENEMISNNVFDTHYIGSYFEKYIDEHLQFKKSTKKQKVFSIHGNMVAHLHSRWGFNKNSREIYLNHAVDAAIVAVLTDQLIRNIADYYRRDNILEQKGSLKFPEPWKSFSIELEARISPQVRDLIKKLNLDSYLDVDILHIKPVFISKKPRRKVNGEAHKSTIRSLIGINEIGKTVTCIKTRLEDIPFDENGDFPMYGKDTDKYTYTAIKERYLEFNKDKEKAFSTPLYKLKRNGEPGNQIKSVKIIDTRNIVNKVNQGKGIAYNSNIIRVDVFSRDQKYYVVPIYLRDFIKGSLPNKIITAAKGFMQWPETDNSYTFLFSIFPNDLIKVVPKEGKFIKAKNENKENINLTEILGYFKGLDSSTGAFTLESHDGSLLARGIGTKNLLLIEKYQVDVLGRYNKVGNEERQDIKIQQN

SEQ ID NO: 288 - protein, 206 aa, Bacteroides cellulosilyticus
MKKILGLDLGCNSIGWALVNEAENTEEISSIIKLGVRVNPLTVDEMQNFEKGKSITTNADRTLKRSMRRNLQRYKLRRDTLIEVLKEHGFITDSTLLSEHGNKTTFETYRLRAKAAVEEISLEKFARVLLMINKKRGYKSSRKAKGSEDGVLIDGMDVARKLYEEGLTPGELCLQILEAGKKNLPDFYRSDLQNEFDRIWNFQKLV

SEQ ID NO: 289 - protein, 349 aa, Bacteroides coprosuis
MKKILGLDIGTNSVGWAVVNTNQEGEPSQIEKLGSRIIPMSQDILDKFGQGQTVSSTASRTDYRGIRRLRERSLLRRERLHRVLHILDFLPKHYADSIGWDPRNSKTYGKFLPGTEVKLAWVPTADGHQFLFYSTYLEMLEDLKQTQAQLFETSQTPVPLDWTIYYLRKKALTQPITKHELAWLLLHFNTKRGYYQRRGELEDTPTDKLVEYHALKVVDVEVDPEDQSKKPWYFVHLENGWIYKRQSSEPLDNWKGLVKEFIVTTHLDKEGKPKLDKEGEVRRSFSSPKEDDWTLVKKKTENDLEKSGLTVGAYIYQTLLNKPNQKIRGGLIKHIERNYYVEELEQILR

SEQ ID NO: 290 - protein, 1504 aa, Bacteroides coprosuis
MKKVLGLDIGTNSVGWAVVNQNDKGEFLSIEKIGSRIIPMSQDVMDKFGAGQTESSTAQRTQYRGVRRLRERSLLRRERLHRVLHILHFLPQHYDAAIGWNKKENKTYGKFLPGVEVNIPWVATDQGHQFIFMDSYAEMLKDLKQHQPHLFEKSSTPVPLDWTIYYLRKKALTQAISKEELAWILLNFNQKRGYYQLRGEEVEDNTKREEFYALKVVKVELDKDNTSAKTWYKVHLENGFIYPCPSDTPIDSWVGMVKDFIVTTTLEKDGSEKRTADGEIKRSFRAPKEDDWTLLKKKTESELEKSGKQVGAFIYDTLLSNPDQKIIGGLIKTIERKYYKKELEQILETQQKFIAELSDKKLFQACAEELYPLNDSHRENLLERDFKHLFVQDIIFYHRPLKTKKSLISNCTYEYRTFYKNGEKQISPIKCIAKSNPLFQEFRVWQFVQNLRILQRQRSEGDSIKYNVDVTAEFLKDENDIANLFTWLNERKVIKQDQLLKSYFKLKVNKETKELDYRWNYVDDKNKEYPCNATRTHILSFLEKCKEEKRIEDDRFVYSLWHLLYSVVEPIELRGALAKFAEREHLHPSFVDVFAQFPPLEKEYGSYSEKAIKRLLPLMRMGDYWHEDKIDVKTKQRIQRIIDGEADDDITHRSREKVENLRSITDFKGLPLWKAGYVVYNRHSESGELTKWKTPHELSNYIQNEFKQYSLRNPIVEQIVLETLRVVHDLWVKHGDFSEIHLELGRDIKNSSDKRKRMAERQQENENSRQRVLEMLIDLKKEAAFADLNPYSPSQQEKLRIVEDGVLRSNIEIPKDIEKITKSAKPTSRELTKYRLWLDQKYRSPYTGQPISLAQLFTSKYEIEHVIPQAKYFDDSFTNKVICESEVNKEKGSMLAHEFILKNGGSTVNVGGRQVQVLKNDAYVELINRLYGKNNPVKAKKLLAEDIDEVVGDFSERQLNDTRYISRVVQKLLSNIVREEDEQESTSKHVIGCSGQVTTALKKDWGLNDIWNKIIQPRFERLNEMTATEDYGVWQSPNHFQIRVPEEIQKGFTKKRIDHRHHAMDALVIACATRSHINYISNRSGQDRNAKFETTRTDLRSKLCYKENSSGNNYNYIFNKPWDTFTQDAHRALENIVVSHKQNLRVLTKTNNYTQFINKDGKKDLQKQVKGDHFAVRKPMHQETIYGRVSIRSIKEVALKKALENWKQIVDRTLKDKIRELIGAYGKYDAQTILKYFKDRDYKFNNLKINRVEVYEYDHNCAAVRKSIGDDLTIKQIERITDESIRKILMNHLSNYDDNLKEAFSPEGLMEMNKNIKELNGGKNHQPIYKVRLFEDLGSKFPLGVSHNNPDKYAIAAKGTNLFFGIYEDQEGKRMFDSIPLNIVIDRLKEKKSPVPETYNESKLKFHLSPNDLVYVPTDEEQKQPELVDVDHLSDEQKGRVYKAVSFTGNRAFFVNHRVSKVIHDYVEFGTKNKIENDDDKRSLKHICWKLKVNRLGEITDVKR

SEQ ID NO: 291 - protein, 1509 aa, Bacteroides eggerthii
MKTILGLDLGTNSVGWAVINSVIKEQAERIWIEMAGSRIIPMDAAVLGDFDKGNSISQTSERTRLRGARRLRERQLLRRERLHKVLNILGFLPNHYLEYIDFEKHPGKFLADAEPKLAWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQVKEFIVTTDLNPDGTPKLDKYGEVKRSFRAPKEDDWMLIKKRTEADIANTHKTVGAYIYDTLLQKPQQKIIGKLVKTVERKLYRDELSLILQKQCAFHAELQDRALYARCVEALYPSNEVRRKNIANRDFVYLLMDDILFYQRPLKTKKSLIANCPYEENEYVDRETGEIKKTPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSSLEKANVCIDFLSNEKEVALWHILYSVSDKQEIEKALRTFAAKNGLDESFVEAFKKFPPFKSEYGAYSAKAIKKMLPLMRCGKYWDVSSIDDTTKERIKKIVTGEYDERISVKVRDKVMNLSDISCFRRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDTVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKLLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKNRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDTPAMIVDKRVKNKVFELLSYKYDKKRIEKYFKENAFLWKELDLAKVAVYYFTEATTEPLVAVRKPLDSTFNEKKIKESVTDTGIQKILLNHLCTKEGKPDLAFSAEGIEEMNRNLLQLNNGKSHQPIYKVRVYEPRGNKFSVGVLGNKGTKWVEAAKGTNLFFAIYITEDGKRTYETIPLNVVIEREKQGLVPVPDRNKKGDKLLFWLSPNDLVYLPTEEEREFGRINEPIDRGRIYKMVSCTGNEGHFIPANVANPIVPVIELGSNNKAQRAWTNEMIKDICIPIKVDRLGHIIEVKYRIDE

SEQ ID NO: 292 - protein, 1526 aa, Bacteroides faecis
MKKILGLDLGTNSIGWAVLNAADDNSLKYIEAAGSRIIPMDAAILGDFDRGNSISQTAERTRIRGMRHLRERYLLRRARLHRILNLLGFLPFHYAQDIDRYGNFSADMEPKIAWCKNLEGELEFIFIESFNEMLEDFRKNQPELVADNKKVPYDWVIYYLRKKALEKKISKEELAWILLNFNQKRGYYQLRGEDDDESMKTAKTRQYFDKQIIKNIIDTNQTYKGQRILIVELQNGDKGKIFKKEIPDWIGQEKNIIVTVDIDKDGNDKYEESGSLSCRFKIPTDAEWESEWKLIKMKTQKDLDESNKTVGTYIYDSILQNPTQKVRGKLVRTIERKYYKAELKQILEKQTEFHSELQDKDLYIECLNELYSNNDTHRNAITDRDFVYLFMNDILFYQRPLKSKKSLIDNCPYERNIYIDKETGEIKYSPIKCIAKSHPLFQEFRLWKFISSIRIYQRESVVEVVDKQLDLFSSQSTSVQKLVTDVDVTDKFLTCENDYVALFEWLNKKKIIDQKEFLKYRPFGLKGDIDNYRWNYVEDKSYPCNETHAMILTYFAKAGISEDILTKEMEEALWHILYSVEDRQEITKALRTFASKYHLSDSFVKVFSNIPPFKKEYGSYSAKAIKKLLSLMRMGKYWSEDAIDVNTRERIDKIVTGEYDEKIRDRVREKTIRLNDIRHFRALPDWLACYVVYDRHSETREITEWKSPEEIDEYIRNFKQHSLRNPIVEQVITETLRTVRDIWKQVGCIDEIHVELGREMKNPADKRKRITSQIIENENANLRVKALLTEFVNSEFEIENVRPYSLSQQDILRIYEDGVLNSVAEVPGDIAGILKKFNENDAKKRPTTSEILRYKLWLEQKYRSPYTGEMIPLSKLFTSAYEIEHVIPQSRYFDDSFSNKVICEAEVNKLKDNALGYEFIKKHHGEKVELGFGKIVEIFSVSVYEQFVKDNYSRNRGKMKKLLMDEIPEQFIERQLNDSRYISKVVKTLLSNVVREKAEQEAVSKNVIVCTGGVTDRLKKDWGINDVWNKIVLPRFLRLNELTNSTNFTAKNAAGNEIPAMPLELQKGFNKKRIDHRHHAMDAIVIACANRNIVNYLNNESASRKAKISRHDLQAILCDKVRTDDKGNYQWRVKKPWDTFTQDVYVALENIIVSFKQNLRVINKTSNYYWHYENGKKVLVKQVKGDSWAIRKPMHKDTVFGEVNLRKVKSVSLNEALKNPQFIVEKDLKRQLLSLLQQNFDIKKIKKYFEEHKDIWSDISLSKMNIYYFTKETKDRYFATRKPLDASFDKKKIESCITDTGIQQILLRHLELKENDPERAFSPDGIDEMNRNIIQLNKGKGHHPIAKVRVYEKADKFEVGQRGNKSSKFVEAAKGTNLFFAVYETEYPDEKTNSIVRKRNYATIPLNIAIERQKRGLSTAPEDEKGNVPSFVLSPNDLVYLPTSEDIVNGHITQPIDKSRIYKMVSSSGSQCFFIKHNIANIIVDKYEFSPLNKMERAISNEMIKEICIPVKVDRLGNIVKLGKSE

SEQ ID NO: 293 - protein, 1509 aa, Bacteroides fluxus
MKTILGLDLGTNSVGWAVINSVIKEQAERIWIEMAGSRIIPMDAAVLGDFDKGNSISQTSERTRLRGVRRLRERQLLRRERLHKVLNILGFLPNHYLEYIDFEKHPGKFLSDAEPKLPWVKDEQGKYTFLFQAAFDEMLADFAIHQPSLVSGDKKIPYDWTIYYLRKKALTEMISKEELAWILLNFNQKRGYYQLRGEEEEDNAGKSVEFYALKVLTVEATDEKKGRDVWYNVHLENGWIYRRSSSVPLDWEGQIKEFIVTTDLNPDSTPKLDKYGEVKRSFRAPKEDDWMLIKKRTEADIANTHKTVGAYIYDTLLQKPQQKIIGKLVKTVERKLYRDELSLILQKQCAFHAELQDRTLYARCVEALYPNNEVQRRNIANRDFVYLLMDDVLFYQRPLKTKKSLIANCPYEENEYVDRETGEIKKAPLKCIAKSHPLFQEFRLWNFLSNIRIYQKEKEINGTLHLDVDVTAEFLKTEDDYVALFDWLNSRKEIEQKTFLKYPKFGLKKEISNYRWNYVEDKQYPCNETRHAILSRLEKANVCIDFLSNEKEVALWHILYSVSDKQEIEKALRTFAAKNGLDESFVEAFKKFPPFKSEYGAYSAKAIKKLLPLMRCGKYWDVSSIDDTTKERIKKIVAGEYDERIAVKVRDKVMNLSDISCFKRLPLWLACYIVYNRHSEDKEAVKWESPADIDAYLASFKQHSLRNPIVEQVITETLRVVRDIWKQVGRIDEIHIELGREMKNPADKRKRMTAQILENENANLRIKALLAEFMNPEYEIENVRPYSPSQQEILRIYEDMVLHAEDQLPEEIDAILKKFNSSKVPTKSEFLRYKLWLEQKYRSPYTGELIPLGKLFTAAYEIEHVIPQSRYFDDSFSNKVICESAVNKLKDNQLGYEFIKNHHGQKVEVGFGKSVEIFSVDSYERFVKEQYAKSAVKMKKMLMDDIPEQFIERQLNDSRYISKVIKGLLSNIVREKNDSGEYEPEAVSKNIVVCTGSVTDRLKRDWGMNDVWNSIVYPRFERLNSLTDTQSFGHWENKSGKKVFQTELPLEYQKGFSKKRIDHRHHAMDAIVIACATRNHVNYLSNESASRNAKISRYDLQRLLCDKSRTDDNGNYKWVIKKPWDTFTQDAREVLSKIVVSLKQNLRIINKTTNVYRHLDATGNRVYEKQKTGDSWAIRKPMHKDTVFGAVNLRKVKVVRLSVALDAPTMIVDKRVKNKVFELLSYKYDKKRIEKYFKENAVLWKELDLARVAVYYFTEATTEPLVAVRKPLDSTFNEKKIKESVTDTGIQKILLNHLCTKEGKPDLAFSAEGIEEMNRNLLQLNNGKRHQPIYKVRVYEPRGNKFSVGVLGNKGTKWVEAAKGTNLFFAIYITEDGKRTYETIPLNMVIEREKQGLAPVPDKNEKGDKLLFWLSPNDLVYLPTEEELEFGRINEPIDRGRIYKMVSSSGNQCFFIPQSISNAIIPTKELGANNKAERSWDGAMIKNICIPVKVDRLGRIIEVKYRINE

SEQ ID NO: 294 - protein, 1436 aa, Bacteroides fragilis; identical to SEQ ID NO: 160

SEQ ID NO: 295 - protein, 1512 aa, Bacteroides nordii
MKNILGLDLGTNSIGWAVINSEEDGPIVKKRIELAGSRIIPMDAAVLGNFDSGVTKSQTAERTSFRSIRRLRERQLLRRERLHKVLQILGFLPEHYVNDIDFENHPGKIKRNTEPKLPWRKNSMGQFEFIFQDSFEAMLTDFATHQPVFVSEGKKVPYDWTLYYLRKKALTEGISKEELAWLILNFNQKRGYYQLRGEEEEEQSNKLVEFYALRVVKVEATDDKKGKDTWYNVHLENGWIYRRTSNIPLDWEGKVKEFIVTTDLNEDGTPKLDKYGEVKRSFRAPKEDDWTLIKKKTESDIANSHKTVGCYIYDALLQNPHQKIKGRLVRTVERKFYKEELRLILEKQLSFHPELQDRDLYRACIDALYVSNEAHKNNISGRDFVYLFIDDIIFYQRPLKTKKSLIDNCPYEENQYMDRETGEVKQAPIKCIAKSHPLFQEFRLWQFISNIRIYQRERVLDDGKLETDVDVTPDFLKTEDDYTTLFEWFNDRKEVDQKAFLKNPQFGLKKTFTEYRWNYVEDKSYPCNETRNAILNGLQKAGVSADFLSREVEEALWHILYSVEDKIEIESALRKFASKHDLDDRFADVFKKLPPFKKEYGAYSAKAIKKLLPLMRIGKYWELSNIDDKTKERIDKIITGEWDENIHDRVREKAIKLSDITDFKGLPLWLSCYVVYNRHSEARAIAKWESPEDIDSYLRLFRQHSLRNPIVEQVITETLRTVRDIWKRVGQIDEIHVELGREIKNPADKRAKMTAQIVENENTNLRIKALLAEFINSEYEIENVRPYSSNQQEKLKIYEDTVLNGVKEIPEDINTILKKFRESDLKKRPTKSDFLHYKLWLEQKYCSPYTGRIIPLGKLFTSAYEIEHIIPQAHYFDDSFSNKVICEAEVNGLKDKKLGYEFIKHNPGKMVEIGFGKPPVRIFSVEEYERFVKENYSGIKNKMNKLLMDDIPETFIERQLNDSRYISKVVKSLLSNIVREKDSNGEYEPEAISKNVIVCTGSVTDRLKRDWGVNDVWNSIIYPRFERLNELTGSQQFGCWENKEGKRVFQTAVPLEMQKGFSKKRIDHRHHAMDAIVIACATRNHINYLSNESASKKAKISRTDLQRLLCTKCRTDDNGNYKWIVKKPWPAFTQDIRKALENITVSFKQNLRVINKTTNYYVHFDESGKKVLEKQINGDSWAIRKPMHKDTVFGKVNLQKVKEVRLSLALDTPKMIVDKKLKEKVLQLYSYKYDKKRIDKYFKENASLWKDLNLSKVAVYYFTNDSTEPLVAVRKPLDTSFNAKKIKESVTDTGIQKILLNHLSNNQDDPNLAFSPDGIDKMNKNLTALNDGKYHQPIYKVRVCEPQGNKFSVGTSGNKTSKYVEAAKGTNLFFAVYQTEDGKRSYETIPLNVVIEREKLGWTPVPENNNNGDKLLFWLSPNDLVYVPTADELNNGMRLDNMDKGRIYKMISCSGPQCFFIPQNVSNAIIPVIELGANNKAEKSWNNEMIKVVCVPIRVDRLGCITQINNQK

SEQ ID NO: 296 - protein, 779 aa, Bacteroides oleiciplenus
MKEGNQYDVACEYAGYRHSKSSLTREEIDNKVLKNRLEILPKNSLRNPVVEKILNQMVNVVNAVIDTYGKPDEIRVELARELKKGAKEREELAKSIAQNTREHEAIRQLLQTEFGMMHVTRNDIIRYKLYEELKDNGYKTLYSDQYIPREKVFSKEIDIEHIIPQARLFDDSLSNKTLEYRAVNIEKGNKTAYDFVKEKYGNDGLRRYLNHCEALFKDKKTKLKKLKMEDQDIPDGFIDRDLRNTQYIAKKALSMLSEISRRVVATTGSITDELRKDWQLVDIMKELNLPKYEALGFVETFKDKDGRIIKKIKDWSKRNDHRHHAMDALTVAFTKDVFIQYFNNKNAFWMSGSKEHANITAIKNKYFEKGKALAPIPLELFRTEAKHHLENILVSIKAKNKVVTNNINRTKKKNGENLKLQQTPRGQLHLESIYGSYRQCIIRDEKVNASFDASKIANVSKSAYRNALLKRLEAYDNDPKKAFTGKNSLDKNPVYLDENKMEKVPDRVKIVEFETVYTIRKPIDPKLSIDKVVDARIRTLLKKRLEEYGGDAQRAFSNIEENPIWLNKEKGISVKRVAIRGISNAQALHDKKDKDGNPILDKEGKGIPTDFVNTSNNHHVAIYRKPVVDKMGQVILDENGSPRYELGEDVISFFEAVARVNLRQPVVDKDYKRSEGWQFLFSMKQNEYFVFPNEKTGFNPKEIDLLNPENYALISPNLFRVQKIGLNDYTFRHHLETSIQNNSNELKFITWIRCGKNGINGVIKVRVNHIGQIVSMGEY

SEQ ID NO: 297 - protein, 653 aa, Bacteroides oleiciplenus
MKKILGLDLGSSSIGWALVNEGANDEEKSSIIKLGVRVNPLTVDEAQNFEKGKSITTNADRTLKRGMRRNLQRYKQRREALVEVLKKHEFITAGTLMSEQGNKTTFETYRLRAKAVEEEISLEEFARVLLMINKKRGYKSSRKAKGDEDGVLIDGMDVAKKLYDEDLNPGELCLQLLEAGKKTLPDFYRSDLQDEFDKIWNFQKQFNPESFCDTAKEEVRGKNRTQTWTILSKYFVWTEGDSVWNNEEARTEERIKEYKLVGIKRTTKGYEQKLENYRWRVQALSEQLNPEIIAIVLQEINGQISASSGYLGAISDRSKELFFNHQTVGQSLMSELDKNPNGSLRNKVFYRQDYLDEFNTIWEKQSLYHKELTVELKKEIRDIIIFYQRRLKSQKGLISTCEFEQREIIVEKDGKRKTKIIGCKVIPRSHPLFQEFKIWQTLNDVEVYVADRRTKRKQDRKSTTLFSDTEDILLVEGKRYLYQEEKELLAKELFVRENMKKAEVLKLLFEDPKELDLNFKQIDGNRTGFALFSAYSKMIEKYGYESVNFKNSADEIIEKLQIIFADLGWNTELFSIDLSKDDKELEKQPYFRLWHLLYSFEGDNTPTGNGKLIEALMRLCSVEKEYASVLANVSFQEDYGSLSAKAIKKYYLI

SEQ ID NO: 298 - protein, 1436 aa, Bacteroides sp.
MKRILGLDLGTNSIGWALVDEAENKDERSSIVKLGVRVNPLTVDELTNFEKGKSITTNADRTLKRGMRRNLQRYKLRRETLMEVLKEHKLITEDTILSENGNRTTFETYRLRAKAATEKISLEEFARVLLMINKKRGYKSCRKAKGAEEGTLIDGMDIARELYNNNLTPGELCLQLLDAGKKYLPDFYRSDLQNELDRIWEKQKEYYPEILTEVLKEELRGKKRDAVWAICAKSFVWEEYYTEWNKEKGKTEQQEREHKLEGIYSKRKRDEAKRENLQWRVNGLKEKLSLEQLVIVLQEMNIQINNSSGYLGAISDRSKELYFNKQTVGQYQMEMLDKNPNASLRNMVFYRQDYLDEFNTLWEKQAEYHKELTGELKKEIRDIVIFYQRRLKSQKGLVGFCEFESRQIEVEIDGKKKIKTVGNRVIPRSSPLFQEFKIWQILNNIEVTVVGKKGKRRKQKDNSPTLFDGLDDTEQLELNGSRYLYQEEKELLAQELFVRDKMTKSDVLKLLFDNPQELDLNFKTIDGNKTGYTLFQAYSKMIEMSGHEPVDFKKTVEKVVEHVKAVFDLLNWNTDILGFNSNEELDNQSYYKLWHLLYSFEGDNTPTGNARLVQKITELYGFEKEYAIILANVTFQDDYGSLSAKAIHKILPHLKEGNRYDVACAYAGYKHSESSLTKEEIANKALKDRLTLLPKNNLRNPVVEKILNQMVNVINAIIDTYGKPDEIRVELARELKKNAKEREELTKFIAETTRKHEEFKILLQSEFGLTNVSRTDILRYKLYKELESCGYKTLYSNTYIPREKLFSKEFDIEHIIPQARLFDDSFSNKTLEARSINLEKGNKTAYDFVKEKFGESGADNSLDHYLNNIEDLFKSGKISKTKYNKLKMAEQDIPDGFINRDLRNTQYIAKKALSMLNEISRRVVATSGTITDKLRQDWQLVDVMKELNWEKYKALGLVEYFEDKDGRQIGRIKDWTKRNDHRHHAMDALTVAFTKDIFIQYFNNKNASLNSNTNEYAIKNKYFQNGRAIAPIPLREFRVEAKKHLENTLISIKAKNKVVTGNINKTKKRGGVNKYLQQTPRGQLHLETIYGSGKQYLTKEEKVNASFDMKKIATVSKSAYRDVLLKRLHENDNDPKKAFTGKNSLDKQPIWLDKEQTRKVPEKVKTVTLETIYTVRKEISPDLKVDKVIDAGVRKILTGRLNEYGNDAKKAFSNLDENPIWLNKEKGISIKRVTISGISNAQSLHVKKDKDGKPILDEDSRNIPVDFVNTGNNHHVAVYRRPVIDKRGQLVIDEAGNPKYELEEVVVSFFEAVTRANLGQPIIDKDYKTSEGWQFLFSMKQNEYFVFPNEKTGFNPKEIDLLDAENYGVISPNLFRVQKFAHKNYVFRHHLETTIKDTSSILKGITWIDFRSSKGLDAIVKVRVNHIGQIVSVGEY

SEQ ID NO: 299 - protein, 1510 aa, Bacteroides sp.
MKRILGLDLGTNSIGWALVDSEEQRILGMGSRIIPMDQGVLDTFSGGNPVETQTAARTAYRGTRRLRERALLRRERLIRVLNMMKFLPEHYASQIDFEKRLGQFFDEKEPKLAWKQNDEGRFEFIFQQSFNEMIEEFKNKGVVREDKKIPYDWTIYYLRKKALSQEIEKEELAWILLNFNQKRGYYQLRGEEEEENPNKLVEYYSLKIVDVIADEKPNSKGDIWYSLHLENGWIYRRSSKIPLFGWKDKTRDFIVTTDLNDDGTVKKDKEGIEKRSFRAPSENDWVLLKKKTESDIEKSHKTVGAYVYETLLQNPMQKVRGKLVRTIERKFYKDELKQILEKQREFHPELRDEDLYNDCVRELYRSNETYQFILSKRDFVHLFLDDILFYQRPLRSQKSAIGDCILEFKTYKDKDGNNIKEYLKVISKSNPLYQEFRIWQWLYNLKIYRKEDDEDVTLQFIANIEDKEQLFDFLSNRKSIEQKPLLEYLIKAKGLKKQVKTEAYRWNYVEDKIYPCSETKTMISTRLAKVENIPDNFFTKEIEQKLWHIIYSVTDKNEFEKALRTFAKKYDLDIASFVDNFKKIPPFKNEYGSFSEKAIKKLLPLMRLGKYWKWNDIDNNTQNRISKIITGEYDEEIKDIVREKSIALTNENDFQGLQLWLAQYLVYGRHSEADIAGKWHSVADLEKYLNEFKQHSLRNPIVEQIITETLRVVRDIWRKYGQGAENFFSEIHVELGRDMKNTADERKKIVNVVTENENTNLRIKALLMELKNNSDGKLEVENVRPYSPTQQDILKIYEEYAISTGLDNEKDEKVKEDIKKISRVAQPTTTELQRYKLWLEQKYCSPYTGKVIPLGKLFTEEYQIEHIIPKSRYYDDSFSNKVICEAAVNKLKDKCLGLEFIKNYHGQIVETGFGQKVTIFDEEAYQNFVKQHYAYNRSKRTKLLLEEIPEKMIERQMNDTRYISKFVLPLLSNLVRAEENDNGVNSKNVLPVNGKITTMLKQDWGLNDVWNDLILPRFVRMNELAKTIAFTSWNEQHQKYLPTVPLELSKGFQKKRIDHRHHAMDALVIACATRDHVNLLNNKHANTDTIRYDLQRKLRLFERVTYIDPQTKNNVTKDIPKEFKKPWDNFTVDARNELEKIIVSFKQNLRIINKATNIYTKYENGKKIKVGQKGLNWAIRKPLHKETVFAKVSLRKRKTVRLSEALKDWKKIVDKKLKQEIKRLTCQYGKFDVDTILRYFKDRKYQFGEVDVSKVKMYYFDEENAAVRKNVDTSFTEKFIQGSVTDTGIQKILLNHLEAKGNKVEIAFSPEGIEEMNKNIIQLNEGKLHLPIFKVRVYETIGNKFSVGVKGNKKDKYVEAAKGTNLFFAIYVDENGIRSYETIPLNIVIERLKQGLSVVPEKNRKEHSLLFYLSPNDLVYVPIEDERENIHAVNLDQLNNEQRKRIYKMVSCTGSECHFVPYYVASPIVNKVEYSSLNKIGRSLTGEMIKDVCIKLKVDRLGNVKGISGL

SEQ ID NO: 300 - protein, 1436 aa, Bacteroides sp.
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKETYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSAIFEELNDAEQLELNGSRRLCQEEKELLAQELFVRDKMTKSEVLKLLFDNPQELDLNFKTIDGNKTGYALFQAYSKMIEMSGHEPVDFKKPVEKVVEYIKAVFDLLNWNTDILGFNSNEELDNQSYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKANEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIETVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKIGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 301 - protein, 1424 aa, Bacteroides sp.
MKRILGLDLGTNSIGWALVNEAETDEEVSSIIRLGVRVNPLTVDETQNFEKGKSITTNAERTLKRSMRRNLQRYKLRRDALVEFLKELGFITDETILSEQGNRTTFETCRLRAKAAEEEISLEELSRVLLMINKKRGYKSSRKVKKEEDGVLIDGMEIAKKLYEEDLTPGQLCSQLLESGKKVLPDFYHSDLQEELDRIWSVQKQFHPDVFCDAAKEEIKGKNRSQTWAILANYFVWKEEVVGWNDREAKNETIEKECKLVGLKRTTKGYELKKENYRWRAQALTEQLGLEEIAVVLQEINGQINASSGYLGAISDRSKVLYFNHQTVGQYQMAELDKNPHASLRNMVFYRQDYLDEFDRIWEKQAEFHKELTAELKKEIRDMIIFYQRRLKSQKGLISFCEFERLEIVVEKDGKKQTKVIGCKVIPRSHPLFQEFKVWQTLNDIKVLGREKKRNALSASESRALYPEEKEILARELAIKENMKKADVLKLLFENPQELDLNFKQIDGNRTGFSLFSAYSKMIEKYGYEPLDFKKPADEIIGQLRTIFTDLGWNTNLFTIDLTKEGKELEMQPYFRLWHLLYSFEGDNTSTGNGKLIEKIMQLCGVEKEYAVELASLSFQDDYGSLSAKAIKRILPYLKEGNLYDVACEYAGYRHSKSSLTKEEIENKVLKGKLEVLPKNSLRNPVVEKILSQMVNVINTIIDTYGKPDEIRVELARELKKSAKEREELTKAIAKSTREHEEIRKLLQDEFGMMNVSRNDIIRYKLYEELKDNGYKTLYSNQYIPKEKIFSKEIDIEHIIPQSRLFDDSLSNKTLEYKAINIEKGNKTAYDFVKEKYGEEGLQQYINRCESLFNDKKAKLRKLKMEQKDIPDGFIDRDLRNTQYIAKKALAMLNEICRRVVATTGSITDQLREDWQLVDVMKELNLPKYEALGFVETYEDKDGRKIKRIKDWTKRNDHRHHAMDALTVAFTKDAFIQYFNNKNAAQDSGNRNHTNIIGIKTRYFDKGRALPPIPLEQFRIEAKQHLEKLLVSIKAKNKVVTVNVNRTKKRKGENTKIQQTPRGQLHLETVYGSHKQYVTKIEKVNASFDAAKIATVSKRAYRNALLKRLETFGNDPKKAFTGKNALEKNPLYADKYQTIRVPEKVQTVEFETIYTIRKPVDPALNVDKVVDVKVRAILERRLKEYGGDPKKAFVNFWENPIWLNKEKGISIKRVSIRGINNAQSIHVKKDKNGNPIWDENGKQIPVDFVNTGNNHHVAIYRKPVLDKKGQVTFDEDGNLMYELDEVVVPFFEAVTRANLGLPIIDKDYRKSEGWQFLFSMKQNEYFVFPNEKTGFNPKEVDLLNPDNYAMISPNLFRVQTMSKVMYGNNVVRDYKFRHHLETTVKDMKELKDIAYKQYKTLSFGNSVVKIRINHIGQIVSVGEY

SEQ ID NO: 302 - protein, 1055 aa, Bacteroides sp.
MRIYRKDLAQDVDVTNELLKTEEDYVALFDWLNGKKEIDQKAFLKYPLFGLKKEVENYRWNYVQDKPYPCNETRSSMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERMDKIITGEYDEKIENRVREKAIHLADVSDFKGLPLWLVCYIVYGRHSEAKEITQWKSPADIDLYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVARQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNHFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKVRWYEQADKFAVGQTGNKSSKFVEAAKGTNLFFAVYESNILDKKTNTIIKKRNYATIPLNVAIERQKQGLPVAPEDENGNDPIFVLSPNDLVYLPTAADLANGIIAQPLDRGRIYKMVSCTGNEGYFIPARIANPILQTIELGSNNKAQKAWTDEMIKEICMPIKVDRLGNVLESSSSYKK

SEQ ID NO: 303 - protein, 1055 aa, Bacteroides sp.
MRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEIIQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEVLRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKSSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSSSGEQCFFIKHIVANVLVDKFEFSPLNKMERALTGEMIKMICIPIKVDRLGNVLESSSSYKK

SEQ ID NO: 304 - protein, 286 aa, Bacteroides uniformis
MLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 305 - protein, 1508 aa, Bacteroides uniformis
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKVKVVRLSVALDTPSMIVNKRVKNKVLELLSYKYDKKKIEKYFKENAFLWKELDIAKVAVYYFTENTTEPLVAVRKSLDSTFNEKKIASVTDTGIQKILLNHLKSKEGKAELAFSAEGIEEMNRNLLQLNDGKGHQPIYKVRVYEPRGNKFKVGVLGNKGAKWVEAAKGTNLFFAIYITEDGNRTYETIPLNWVIEREKQGLVPVPDRNEKGDKLLFWLSPNDLVYLPTEEERDFGRINEPIDRGRIYKMVSSSGNQCFFIPQSISNAIISTKELGSNNKAEKSWDGEMIKNICIPVKVDRLGRIIEVKYRVNE

SEQ ID NO: 306 - protein, 1210 aa, Bacteroides uniformis
MRTILGLDLGTNSIGWAVINSVIKEQTERIWIEMAGSRIIPMDAAILGDFDKGNSISQTAERTRFRGVRRLRERQLLRRERLHKVLKILGFLPEHYLKGIDFEKHTGKFLSGSEPKLPWVKDRWGKYSFLFQTAFNEMLADFAKHQPSLVFDGKKIPYDWTVYYLRKKALTEMISKEELAWILLNFNQKRGYYQLRGEEEEDNAGKSVEFYALKVLSVEATDEKKGRDIWYNVHLENGWVYRRSSNVPLDWEGRVKEFIVTTDLNPDGTPKLDKYGEVKRSFRAPKEDDWMLIKKRTEADITGTHKTIGSYIYDALLQEPQQKIIGKLVKTVERKFYKEELNFILQKQCAFHAELQDRDLYMRCIEALYPGNEVQRRNIANRDFIYLLIDDVLFYQRPLKTKKSLIANCPYEENEYVNRKTGEIKTAPLKCIAKSHPLFQEFRLWYFLSNIRVYQKEREVNGTLHLDVDVTTEFLKTEDDYVALFDWLNSRKEIDQKAFLRYPAFGLKKEINNYRWNYVEDKFYPCNETRHAILSRLEKAGIGIDFLSDEKETALWHILYSVSDKQEIEKALATFAVKNGLNESFVEVFKKFPPFKSEYGAYSAKAIKKLLPLMRCGKYWDMSLIDGTTKERIERIIAGECDESIGAKVREKAMNLSDISCFKRLPLWLACYVVYNRHSEDKEITKWETPADIDAYLAAFKQHSLRNPIVEQVITETLRVVRDIWKQVGKIDEIRIELGREMKNPADKRKRMTTQILENENANLRIKALLAEFVNPEYGVENVRPYSPSQQEILRIYEDAVLKGEEQIPEDIDVILKKFNTSKLPTKSEFLRYKLWLEQKYRSPYTGELIPLAKLFTAAYEIEHVIPQSRYFDDSFSNKVICESAVNKLKDNQLGYEFIKNHHGQKVEVGFGKTVEIFSVDSYERFVKEQYAKSGIKMKKLLMDDIPEQFIERQLNDSRYISKVVKGLLSNIVREKNDSGEYEPEAVSKNILVCTGSVTDRLKKDWGMNDVWNSIVSPRFERLNALTETQCFGHWENKDGKKVFQTAVPLEYQKGFSKKRIDHRHHAMDAIVIACATRNHVNYLNNESASRNAKISRYDLQRLLCDKSRGDGNGNYRWIIKKPWTTFTQDAREALSGIIVSLKQNLRIINKTTNIYQHFDANGTRVYEKQKIGDSWAIRKPMHKDTVFGAVNLRKALIPQHYNLTLFISS

SEQ ID NO: 307 - protein, 1504 aa, Bacteroides vulgatus
MKNIVGLDLGTNSIGWAVVNGSVNDDGSEQLVKIQASGSRIIPMDAAMIGDFNKGNSISQTAERTRLRGVRRLSERYLLRRERLHRILDILGFLPFHFAQDLDRHGKIVKGKEPKLAWRKNEAGQFEFIFQDSFKEMLEDFKLNHPNLITDDKKVPYDWTIYYLRKKGLTSKISKEELAWILLNFNQKRGYYQLRGEEEEENKNKLVEFYALKVVAVEDSGEKKGKDIWYNVHLENGWVYRRTSNMPLDWVGKTKEFIVTTDLEKDGTPKKDKEGNVKRSFRAPKEDDWSLLKKKTEADIDQTHKTVGVYIYDTLLGNPSQKIRGRLVRTIERKYYKEELKQILEKQKEFHLELQDRALYAACIEELYPINEAHRNNVGNRDFTYLFLEDILFYQRPLKSKKSLIDNCPYEENQGLDKETGEIKSFPVKCIAKSHPLFQEFRLWQFIVNLRIYRKDLAQDVDVTNELLKTEEDYVALFDWLNGKKEIDQKAFLKYPVFGLKKEIENYRWNYVQDKPYPCNETRSLMLARLEKCDISIEFLTKENEEALWHILYSVEDKNEIVKALQKFADKHDLNASFVDVFQKFPPFKKEYGSYSAKAIKKLLPLMRMGKYWSENSIDKGTRERIDKIITGEYDEKIENRVREKAIHLADVSDFKGLPLWLVCYIVYGRHSEAKEITQWKSPADIDSYLRSFKQHSLRNPIVEQIIIETLRVVRDIWKQVGNIDEIHVELGREMKNPADKRKKMTQQMSENENTNLRIKYLLTEFLNPEYEVENVRPYSPSQQDILRIYEEGVLNSVSDLPEEISDILKKFTETDLKKRPSRSEILRYKLWLEQKYRSPYTGEVIPLGKLFTPAYEIEHVIPQSCYFDDSFSNKVICEAEVNKLKSNLLGHEFIVKHHGEIVELPFGKKVRIFTVDEYEQFVKDNYSRTRSKMKKLLMDDIPEEFVTRQLNDSRYISKVVKSLLSNIVREKGEEEAISKNVIPCTGGVTDRLKKDWGINEVWNKIILPRFQRLNELTGTNKFTTKNVGIQEIPTMPLELQKGFNKKRIDHRHHAMDAIIIACANRNIINYLNNESATAKAELSRYDLQKMLCDKAKTDNNGNYKWVIRKPWASFTQDTYLALENIIVSFKQNLRVINKATNRFLHYNEEGKKIFVKQGKGDNWAIRKSMHKDTVFGEVNLRRIKTVALNEAMKNPQSIVVKDFKRKLLELWNLGFDAKRIKKYFEDNRETWSDINLSKIEVYYFSKDTKDRFFATRKPLDTSFDRKKIENNITDTGIQKILLRHLELKDNNPDIAFSPDGIDEMNRNIIQLNNGKYHQPIIKIRWYEQADKFAVGQTGNKFSKFVEAAKGTNLFFAVYESNILDKKTNTIIKKRNYATIPLNVAIERQKQGLPVAPEDENGNDPIFVLSPNDLVYLPTDDELANGIIAQPLDRGRIYKMVSCTGNEGHFIPARIANPILQTIELGSNNKAQKAWTDEMIKEICMPIKVDRLGNVLESSSSYKK

SEQ ID NO: 308 - protein, 1153 aa, Barnesiella intestinihominis
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 309 - protein, 1352 aa, Belliella baltica
MKKILGLDLGTTSIGWAFIKEPEKDVVGSEIVDMGVRIVPLSSDEENDFAKGNTISINADRTLKRGARRNLQRFKQRRNALLEIFKEKKLISTNFKYAEDGPSSTFSTLNLRAKAAKEKIELQDLVKVLLQINKKRGYKSSRKAKSEEDDGSAIDSMGIAKELYENDLTPGQWVYEALQKGRKNVPDFYRSDLQEEFKKIVNYQSEFFPDIFNASFVEDWMGKASTPTKQYFNKKGVQLAENKGKREERRLQEYKWRAEAVNFKIDLSEIALILSQINSQISNSSGYLGAISDRSKELYFKNLTVGQYLYQQIKKNPHTRLKGQVFYRQDYLDEFERIWSVQSSFYPQLNDALKREVRDITIFFQRRLKSQKHLISNCEFEDHHKVVPKSHPVFQEFRIWQNLNNLLLIKKDNLNEKFDLELESKIALANELAFKRELNVKDALKILGLKPNEWEFNFTKIEGNRTNQAFFDAFAKIIELEDGEPIDLGDLKADDILDQFSEAFLRIGIDTELLQVNSDIEGAEYEKQSYIQFWHLLYSSEDDQKLKLNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPELGRPDEIRVEMARELKANAEQRKNMTSNIASATRDHDKYREILKSEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEISRRVSVTTGTITDKLREDWGLVEIMKELNWEKYDKLGLTYTIEGKHGERLNKIKDWSKRNDHRHHAMDALTVALTKPAYIQYLNNLNAKGLNNKKGTEVFAIEQKYLKRENGKLCFIPPIENIRSEAKKHLSRILVSYKAKNKVVTINKNKTKSKAGLNEQIALTPRGQLHKETVYGKSFHYSTKFEKIGASFNVQKINTVAKKEEREALLKRLAENGNDPKKAFTGKNTLNKMPIYLDLGKNIKLSEKVKTVVLEQNYTIRKNIDPDLKVDKVIDVGIKRILESRLEEFGGNAKLAFSNLEENPIWLNKEKGISIKRVKISGVSNVESLHVKKDHFGEPILDQEGNEIPVDFVSTGNNHHVAIYEDENGNLQEEVVSFFEAVVRQNQGLPIIKKNHTLGWKFLFTLKQNEYFVFPSDDFVPADVDLMDEQNYHLISPNLFRVQKIARKNYVFNNHLETKAVDNDLLKSKKELSKITYHFYQTPEHLRGIIKIRINHLGKIIQIGEY

SEQ ID NO: 310 - protein, 1415 aa, Bergeyella zoohelcum
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 311 - protein, 1430 aa, Bergeyella zoohelcum
MKHILGLDLGTNSIGWAVVKEAQNDNEQSEIVDVGVRVNPLTTDEKTNFEKGKPISTNADRTLKRSARRNLQRYKLRRKELIELLKEHQLISTDTILTENGKGTTFQTLELRAKSAKEKISLEELARVFLTINKKRGYKSSRKAKNEDEGQLIDGMEIAKRLYEENLTTGQLSLQLLKEGKKSLPDYYRSDLQFELDKVWNFQKQFHSDILTDEFYAQLKGKGQRATSALFLAKYQIYTAENKGSREDKKLQAYQWRVDALSKELTREQLAFVITEINNNLNNSSGYLGAISDRSKELYFNNETVGEYLWKQIAANPHTSLKNQVFYRQDYLDEFEQIWKTQSAFYPEILTDELKKELRDVVIFYQRKLKSQKSLVSFCEFENKEIEIKKEDGTSTKKVIGLKVAPKSSPLFQEFKIWQNLNNVLIRKKGSKTKKVAKNQQAVLFEEEKTISELDLEAKQALFNELNLKGNLKADYCLEILGYSPKEWEMNYSVLEGNRTNKALYEAYLKITDLEGYDAKNHLKVKLNKDEVELDDLKVPASEIKDMVQAIFKEAGINTDILHFNAELDGKDFENQASYQLWHLLYSYEGDDSKSGNELLYKLLETKFGFKKEYAQILANVSLSDDYGSLSTKAMRKIHPYIKENKFSTACELAGYRHSKHSLTKEENDNRVLKDSLEVLKKNSLRQPVVEKILNQMINLVNALLKKYRTENPNFKFDEIRIELARELKKNAEERANMTANINKAKTEHEKIIKILKNEFGLPNPTRNDIIRYRLYEELKANGYKDLYTNIKIPQEKLFTKEIDIEHIIPKSRVFDDSFSNKTLSFRKTNLDKGERTAFDYMESKFGADKLEEYVARVEDLYKNNIISKAKYQKLLKKESEIGDGFVERDLRETQYIAKKAKEILLQITPNVLSTSGGITDRLREDWDLINVMKELNLPKYRALGLTQMEDRKYGQQVEVITDWTKRNDHRHHAMDALTVAFTKHNHIQYLNYLNARKNEKHKEHSNIMGIQQLETIKVTDKNGNEKRVFKAPMPNFRQVTKAFLENILISHKAKNKVVTKNKNKVAGSNKVQEVLTPRGQLHKETVYGKYQYYVQKEEKIGAKFDLETIKKVANPLYQSLLKKRLEENGGDPKKAFTGKNSLAKNPIYLDDTQTEQLPEKVKLVWLENSFSIRKDITPENFKDEKLIDKILDEGVKRILKERLQSFGNDAKKAFSDLDKNPIWLNKEKGITIKRVTISGVANAEPLHTKKDHLGKEILDKEGKPIPVDFISTGSNHHVAVYRDEKGNLQEKVVSVFEAVVRANQGLPIIDKTYNQHLGWEFLFTMKQNEMFVFPNESTGFNPNDIDLLDPKNKRIISPNLFRVQKFSKLQYGNSFVREFVFRHHLETTVEDRKELQGITYKQMKNSTFFNDIIKVRINHLGDIVSIGEY

SEQ ID NO: 312 - protein, 1281 aa, Bifidobacterium bifidum
MEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLAFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 313 - protein, 1121 aa, Bifidobacterium dentium
MSVGLAAIEVDETGFPIRILNIQSVIHDGGIDPQLGKKKSISRKAISGVARRTRRMRRRKVVRLRQLDATLESLGFPIVEPDSLDTWEIWLTRAKLASSYIQDDETRKEDVSIALRHIARHRGWRNPYSNVESLFVDVAPSEQYEELRRKAEEKLGTSLSGNPTSAEIVECILKRQVGEVQLRTRSRKGVNGNAVEKEGLLPTKLMQSDNAAEIRRIFKVQRIDDETGRKLLRAVFKACSPKGSVERRVGRDALAPGLPRALKASLAFQEYRIANVLTNLVISEDGTKRKLTIAEKQRVFGFLSSNETDDITWIDVAEKLGLERRQIQGVGCLTADGEERISSTPPRNITALHIHSAKPVIREKLVAWWKAASPTVRETMVELLSNTVDIDRVREDMDYSSAVAFIDSLGDEELTALDSVDLLSGRAAYSRQTLKQLTERMLNTDDDLHEARKAVFGVDDNWKPPVDAISTSVGNPAVDRVLKIVNRYLLACQKRWRNPQSVQIEHVRESFSSVAKAKETERVQGERARYRNDLRRELCEQEGLNKIRESDIRRWESVQRQNGTCLYCGSPITFRTCEMDHIVPRKGVGSTNTRVNLAAACAACNKLKSNTAFSVWARTEGAANRKVSQRDAIERVKTFIFNKSVPPREQRAFKQAVISRLRQAESDPAIDNRSIESVAWMADELHRRIEAYFNQDADVSGNTPATQVWVFQGRVTALARKASGIEGRIHFAGEWKKTRLDRRHHAVDAAVIAMMNHSAAQTLVERDSLRLSQWITRKPETWKNYPFSEGQKKTRFKEWLDCMNALLDLLNDALDSDRVPVTRCQRMSLGNSQAHAATIRKMKRVELFSPMDADLIRRASTPALYCALTRLPEYSPEKGLPENRGREIVLNGRHIRSTETVDFFASGAAQLMVRNGSAEIGDSIHHMRIYRYRKTGAKSQEYVYGMIRVFQIDLLHASSENLFAVQLPSQSVSVRYGDKNVVQAIQEGRAEYLGHIVPNDEILISYEGVRMKDSEKIGAYANDFSGTASELAQRRHWVVVGSDVSKLALRPSYLSEEGLENSGSESERLSKQTRKVIEGKGWVVAVNILAKYHPVVIRRNALGEPRFRTNSGMPVSWRWDR

SEQ ID NO: 314 - protein, 354 aa, Bifidobacterium longum
AKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWV

SEQ ID NO: 315 - protein, 1124 aa, Bifidobacterium longum
LTGHSGHTFWPTSSSPPIQLEQEKRPLPQRNTSQNGHTFWPITRERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFPVSMLMVRLASIYNSSRSLVEGTLHGNIGLLMDSLTRRS

SEQ ID NO: 316 - protein, 166 aa, Bifidobacterium longum
MGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPA

SEQ ID NO: 317 - protein, 1138 aa, Bifidobacterium longum
MNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 318 - protein, 182 aa, Bifidobacterium longum
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPA

SEQ ID NO: 319 - protein, 441 aa, Bifidobacterium longum
MVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRM

SEQ ID NO: 320 - protein, 967 aa, Bifidobacterium longum
MVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 321 - protein, 1151 aa, Bifidobacterium sp.
MRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 322 - protein, 1092 aa, Brevibacillus laterosporus
MAYTMGIDVGIASCGWAIVDLERQRIIDIGVRTFEKAENPKNGEALAVPRREARSSRRRLRRKKHRIERLKYMFVRNGLAVDIQHLEQTLRSQNEIDVWQLRVDGLDRMLTQKEWLRVLIHLAQRRGFQSNRKTDGSSEDGQVLVNVTENDRLMEEKDYRTVAEMMVKDEKFSDHKRNKNGNYHGVVSRASLLVEIHTLFESQRQHHNFLASKDFELEYINIWSSQRPVATKDQIEKMIGTCTFLPKEKRAPKASWHFQYFMLLQTINHIRITNAQGTRPLNKEEIEQVVNMALTKSKVSYHDIRKVLDLSEEYQFVGLDYGKEDEKKKVESKETIIKLDDYHKLNKIFNEVELAKGETWEAVDYDTVAYALTFFKDDEDIRDYLQNKYKDSKNRLVKNVANKEYTNELIEKVSTLSFRKVGHLSLKALRKIIPFLEQGMTYDKACQAAGFNFQGISKKKRSVVLPVIDQISNPVVNRALTQTRKVINALIKKYGSPETIHIETARELSKRFDERKNITKDYKENRDKNERAKKHLSELGIINPTGLDIVKYKLWCEQQGRCMYSNQPISFERLRESGYTEVDHIIPYSRSMNDSYNNRVLVMTRENREKSNQTPYEYMGNDTQRWDEFEQRVTTNPQIKKEKRQNLLLKGFTNRRELEMLERNLNDTRHITKYLSHFISTNLEFSPSDKKKKVVNTSGRITSHLRSRWGLEKNREQNDLHHAMDAVVIAVTSDSFIQQVTNYYKRKERRELNGDDKFPLPWKFFREEVIARLSPNPKEQIEALPNHFYSEDELADLQPIFVSRMPKRSITGEAHQAQFRRVVGKTKEGKNITAKKTALVDISYDKNGDFNMYGRETDPATYEAIKERYLEFGGNAKKAFSTDLHKPKKDGTKGPLIKSVRIMENKTLVHPVNKGKGVVYNSSIVRTDVFQRKEKYYLLPVYVTDVTKGKLPNKVIAAKKGYDDWIEVDDSFTFLYSLYPNDLIFIRQNPKKKISLKKRIESHSISDSKEVQEILTYYKGVDSSTAAIEFITHDGSYYAKGVGVQNLDCFEKYQVDILGNYSKVKGEKRLELETSDNNHKGKDVNSIKSTSR

SEQ ID NO: 323 - protein, 103 aa, Butyrivibrio fibrisolvens
MISVGQSRKDLEDLGYEFKLSFYKEDIIEYEKNGDILVERFLSRTMPQVRNYIETKPIDRPKYDKRNPVGLSKTSSIRKITMDILGNRFYVDKMSFNNVVGTQ

SEQ ID NO: 324 - protein, 177 aa, Butyrivibrio fibrisolvens
MLIAFSQMGYDAYHELTNKYIDFETGEIIDKEGFNELLNNDLVYKNTMYESKWLKIKGNIEKAAEKNKYWYQVNKKCNRGLCNQTVYGTRESDGDVYKISKIDIRTDDGFKKFKNIVDKGNESVFLMYENDPKTFELIMDIYKNYSDSKNPFVQYEKETGDIIRKYSKKITGQRFLN

SEQ ID NO: 325 - protein, 1442 aa, Caenispirillum salinarum
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 326 - protein, 984 aa, Campylobacter coli
MARILAFDIGISSIGWAFSENDELKDCGVRIFTKAENPKTGESLALPRRLARSARKCLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 327 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 328 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 329 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 330 - protein, 987 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 331 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 332 - protein, 987 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 333 - protein, 984 aa, Campylobacter coli
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLTNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 334 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 335 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVVLSSGMITQMLRNFWYLGFKNHKNYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANTKGSLVRTDLFVDKENKFHAVSIYKADFSTKKLPNKTPATTSNGETKEGIEMNENYNFCMSLYKNTPVSVKIKGMKEPIICYYHGFNTSGSKITYKKHDNNYHNLSEDEMVVFRKNDKESIVVGKILEIKKYSISPSGELSLIENEKRKWF

SEQ ID NO: 336 - protein, 965 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSAIILHIAKHRGYDDSALKNENGTIIEALNKNKEAMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNAENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKILTFKKLNDLKQGKTPFEAFGEDEKLWAEINERIKEYNGKKRFKIFDKFFKDKKPFDFTEQTLQDTRWLTKLVASYLNEYLLFLPINEDENTALGYGEKGSKQHVVLSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANAKGSLVRTDLFADKENKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIVVGKILEIKKYSISPSGELSLIENEERKWF

SEQ ID NO: 337 - protein, 933 aa, Campylobacter coli
MKIIGFNLGIANIGWALRENDEIIDCGVRVFDIPENPKNGNSLALERRENKARMKIVKRKKARMLATKTFLKKELNVDLSKLFLIGSTQSIYELRTKALSSLISKEELSVIILHIAKHRGYDDSALKNENGTIIEALNKNKETMLKFKSVGEYFYKNFVQNKEVKKIRNTTEDYSNSVPRSLLKQELDLILDRQKELGLIKNADFKAKLFEIIFFKRPLKDFSNKIGNCIFFENEKRAAKNTISACEFVALGKVVNLLKSIEKDIGIVYEKDSINEIMSIILDKTSISYKKIRDILNLPQDINFKGLDYSKNNVENSKLVDLKKLNEFKKALGDGFTNLDKDILDSIATDITLTKDTATLKEKLKNYNVLNAEQIEKLSELVFNDHINLSLKALKQIIPLMYEGKRYDEACELCNFTIAKNQEKNEYLPLFEKTRFAKDISSPVVIRAICEFRKLLNDIIRRYGSVHKIHLELTRDFGISFNDRKKIIKEIEQNEQSRIKALETIKELKLEETSKNIQIVRLFEDQKGICPYSGLKMDLKCLDELVIDYIRPYNRSLDDSYSNKVLTFKKLNDLKQGKTPFEAFGEDEKLWAEINERIKEYNGKKRFKIFDKFFKDKKPFDFTEQTLQDTRWLTKLVASYLNEHLSFLPISEDENTALGYGEKGSKQHVILSSGMITQMLRNFWYLGFKNHKDYKNNAMDAIIVAFTTNSIIFTFNNFKKELDLAKAEFYANKISESDYLLKRKFLPPFSGFKEQALEKVKNIFVSHSLKIKNKGTLHELTPLKIKELKNTYGDLDLAVKLGKIRKYNDKYYANANGSLVRSDLFIDKKNKFHAVPIYKADFSTKKLPNKTPATTSNGETKEGIEMNENYNFCMSLYKNTPISVKIKGMKESIICYYHGFNTSGSKITYKKHDNNYHNLSEDEMVVFRKNDKE

SEQ ID NO: 338 - protein, 666 aa, Campylobacter jejuni
KGEKGTYFIEFKKYKEFIKALDEHSLSQDDLNEIAKDITLIKDEIKLKKALAKYDLKENQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAELECEKLGLKINSKNILKLRLFKEQKEFCVYSGEKIKLSDLQDEKMLEIDHIYPYSRSFDDSYMNKVLVFAKQNQEKLNKTPFEAFGNDSTKWQKIEVLTKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDEDYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 339 - protein, 190 aa, Campylobacter jejuni
MAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKKVMNAA

SEQ ID NO: 340 - protein, 985 aa, Campylobacter jejuni
MAKILAFDIGISSIGWAFVENDELKDCGVRIFTKAENPKTGESLALPRRLARSARKRLARRKARLNHLKHLIANEFKLNYEDYQSFDESLAKAYKGTLISPYELRFKALNELLSKQDLARVILHIAKRRGYDNIKNSDDKEKGAILKAVKENEEKLANYKSVGEYLYKEYFQKFKENSKEFINVRNKKESYERCIAQSFLKDELKLIFQKQREFGFNFSKKFEEEVLSVAFYKRALKDFSHLVGNCSFFVDEKRAPKNSPLAFEFVALTRIVNLLNNLNKNNSYIKDDLNALLSEVLKNGTLTYKQTKKILGLSDDYEFKGQKGNYFIEFKKYKEFIKALCEHNLNQDDLNEIAKDITLVKDETKLKKALAKYDLNQNQIENLSKIEFKDHLNISFKALKLIVPLMREGKKYDEVCNELNLKTAINEDKKEFLPAFNETYYKDEVNNPVVLRAIKEYRKVLNSLLKKYGKVHKINIELAREVGKNHRERSKIEKEQNENFKAKKDAELECEKLGLKINSKNILKLRLFKEQKEFCVYSGEKIKISDLQDEKMLEIDHIYPYSRSFDDSYMNKVLVFTKQNQEKLNKTPFEAFGKDDVKWQKIETLAKNLPAKKQKRILDKNYKDKEQKDFKDRNLNDTRYIARLVLNYTKDYLEFLPLSDDENIKLNDTQKGSKVHVEAKSGMLTSVLRHTWGFSTKDRNNHLHHAIDAVIIAYANASVVKAFSDFKKEQENYTAELYAKKINELDFKNKRKFFEPFSNFRQKVLEKIDEIFVSKPERKKPSGALHEETFYKEEEFYKEYGGKEGVLKALELGKIRKVNGKIVSNANMFRVDIFKYKKTNKFYAVPIYTMDFALGILPNKAVVGGKDKQGIIKDWLLMDENYEFCFSLYKDSLILLQTKDMQEPELVYFKSFKSSTAGLVVSKHDNKFENLNENQKKLFKSANEKKVVAEGIGIQNLKVFEKYIVSALGEITKAEIKERENFKKK

SEQ ID NO: 341 - protein, 987 aa, Campylobacter jejuni
MARILAFDIGISSIGWAFSENDELKDCGVRIFTKAENPKTGESLALPRCLARSARKRLARRKARLNHLKHLIANEFKLNYEDYQSFDESLAKAYKGSLISPYELRFRALNELLSKQDFARVILHIAKRRGYDDIKNNGDEEKGEILKAIKQNEEKLVSYQSVGEYLYKEYFQKFKENSKEFINVRNKKESYERCIAQSFLKDELKLIFQKQRKFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKIVSNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 342 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDEGLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 343 - protein, 961 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFSDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNIGFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKLSDLQDEKMLEIDHIYPYSRSFDDSYMNKVLVFTKQNQEKLNKTPFEAFGNDNVKWQKIEVLAKNLPEKKQKRILDKNYKDKEQKDFKDRNLNDTRYIARLVLNYTKDYLDFLPLSDDENTKLKGSKVHVEAKSGMLTSALRHTWGFSTKDRNNHLHHAIDAAIIAYANNSIVKDFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNLKVFEKYIVSALGEVTKAEFRQREDFKNELR

SEQ ID NO: 344 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVNYQSVGEYLYKEYFQKFKENSKEFINVRNKKESYERCITQSFLKYELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 345 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKGKILKAIKQNEEKLVSYQSVGEYLYKEYFQKFKENSKEFINVRNKKESYERCIAQSFLKDELKLIFQKQREFGFSFSKKFEEEVLSVAFYKRALKDFSHLVGNCSFLLMKKERQKNSPLAFMFVALTRIINLLNNLKNTEGILYTKDDLNTLLNEALKNGTLTYKQTKKLLGLSNDYEFKGEKGTYFIEFQKYKEFVKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNKTPFETFGNDRVKWQKIEVLAKNLPTKKQKRILDKNYKDKEQKDFKDRNLNDTRYIARLVLNYTKDYLDFLPLSDDENTKLNDTQKGSKVHVEAKSGMLTSTLRHTWGFSTKDRNNHLHHAIDAAIIAYANNSIVKAFSDFKKEQESNTAELYAKKISELDYKNKRKFFEPFSGFRQKLLDKIDEIFVSKPERKKPSGALHEETFRKEEEFYQSYGGKEGVLKALELGKIRKVNGKMVKNGDMFRVDIFKHKKTNKFYAVPIYTMDFALKVLPNKAVVQGKDKKSGLIKDWILMDENYEFCFSLYKDSLILIQTKDMQEPELVYYERLDSSNASLTVSKHDNKFETLSKNQKILFKNANEKEVIAKSIGIQNLKVFEKYIVSALGEVTKAEFRQREDFKK

SEQ ID NO: 346 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYPVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 347 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFHQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 348 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDNLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 349 - protein, 861 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFLCCANLYYGFCFKSITK

SEQ ID NO: 350 - protein, 462 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINILNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKS

SEQ ID NO: 351 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNNGDEEKSEILKAIKQNEEKLVNYQSVGEYLYKEYFQKFKENSKEFINVRNKKESYERCITQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALDEHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKILNALLKKYGKVHKINIELAREVGKNHSQRAKIEKEQNENYKAKKDAEIECEKLGLKINSKNILKLRLFKEQKEFCAYSGEKIKISDLQDEKMLEIDHIYPYSRSFDDSYMNKVLVFTKQNQEKLNKTPFEAFGNDGVKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAAIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLVVSKHDNKFETLSKNQKILFKNANEKEVIAKSIGIQNLKVFEKYIVSALGEVTKAEFRQREDFKK

SEQ ID NO: 352 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 353 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGLKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 354 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHTIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 355 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTFLNEVLKNGTLTYKQTKKLLGLSDDYEFKGEKGTYFIEFKKYKEFIKALGDHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 356 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKSLGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 357 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALVKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 358 - protein, 983 aa, Campylobacter jejuni; identical to SEQ ID NO: 236

SEQ ID NO: 359 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLVNYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSEKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 360 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIAKRRGYDNIKNSDNEEKSEILKAIKQNEEKLVNYQSVGEYLYKEYFQKFKENSKEFINVRNKKESYERCIAQSFLKDELKLIFQKQREFGLSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVVINEDKKDFLPAFNETYYKDEVTNPVVLRAIKEYRKVLNALLKKYGKVHKINIELAREVGKNHSQRAKIEKEQNENYKAKKDAELECEKLGLKINNKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPTKKQKRILDKNYKDKEQKDFKDRNLNDTRYIARLVLNYTKDYLDFLPLSDDENTKLNDIQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVVQGKDKKSGLIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 361 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAEFECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 362 - protein, 984 aa, Campylobacter jejuni
MARILAFDIGISSIGWAFSENDELKDCGVRIFTKAENPKTGESLALPRRLARSARKRLARRKARLNHLKHLIANEFKLNYEDYQSFDESLAKAYKGSLISPYELRFRALNELLSKQDFARVILHIVKRRGYDDIKNSDDKEKGTILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNTLLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 363 - protein, 987 aa, Campylobacter jejuni
MARILAFDIGISSIGWAFSENDELKDCGVRIFTKAENPKTGESLALPRRLARSARKRLARRKARLNHLKHLIANEFKLNYEDYQSFNESLAKAYKGSLISPYELRFRALNELLSKQDFARVILHIAKRRGYDDIKNSDDKEKGAILKVIKQNEEKLANYQSVGEYLYKEYFQKFKENSKEFTNVRNKKESYERCIAQSFLKDELKLIFQKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKNELR

SEQ ID NO: 364 - protein, 984 aa, Campylobacter jejuni
MARILAFDIGISSIGWAFSENDELKDCGVRIFTKAENPKTGESLALPRRLARSARKRLARRKARLNRLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGDHSLNQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCVYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 365 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFLKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEAYNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 366 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSNDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 367 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 368 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVTLTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 369 - protein, 984 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFIQREDFKK

SEQ ID NO: 370 - protein, 987 aa, Campylobacter jejuni
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRVPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYGVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKNELR

SEQ ID NO: 371 - protein, 984 aa, Campylobacter jejuni
MARILAFDIGISSIGWAFSENDELKDCGVRIFTKVENPKTGESLALPRRLARSARKRLARRKVRLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 372 - protein, 721 aa, Campylobacter jejuni
MFVALTRIINLLNNLKNTEGILYTKDDLNTLLNEVLKNGTLTYKQTKKLLGLSDDYEFKGEKGTYFIEFKKYKEFIKALGDHSLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNYSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKDFKDRNLNDTRYIARLVLNYTKDYLDFLPLSDDENTKLNNTQKGSKVYVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 373 - protein, 512 aa, Campylobacter jejuni
MHKINIELAREVGKNHSQRAKIEKEQNENYKAKKDAEIECEKLGLKINSKNILKLRLFKEQKEFCAYSGEKIKLSDLQDEKMLEIDHIYPYSRSFDDSYMNKVLVFTKQNQEKLNKTPFEAFGNDSTKWQKIEVLAKNLPEKKQKRILDKNYKDKEQKDFKDRNLNDTRYIARLVLNYTKDYLDFLPLSDDENTKLNDTQKGSKVHVEAKSGMLTSALRHTWGFSAKDRNNHLHHAIDAAIIAYANNSIVKAFSDFKKEQESNSVELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPELVYFNAFTSSTVSLIVSKHDNKFETLSKNQKILFKNANEKEVIAKSIGIQNLKVFEKYIVSALGEVTKAEFRQREDFKK

SEQ ID NO: 374 - protein, 965 aa, Campylobacter jejuni
MKIIGFNLGIANIGWALRENDEIIDCGVRVFDIPENPKNGNSLALERRENKARMKIVKRKKARMLATKTFLKKELNVDLSKLFLIGSTQSIYELRAKALSSLISKEELSAIILHIAKHRGYDDSALKNENGTIIEALNKNKETMLKFKSVGEYFYKNFVQNKEVKKIRNTTEDYSNSVPRSLLKQELDLILDKQKELGLIKNADFKEKLFEIIFFKRPLKDFSNKIGNCIFFENEKRAAKNTISACEFVALGKVVNLLKSIEKDIGIVYEKDSINEIMSIILDKTSISYKKIRDILNLPQEINFKGLDYSKNNVENSKLVDLKKLNEFKKALGDGFANLDKDILDSIATDITLTKDTATLKEKLKNYNVLNAEQIEKLSELVFNDHINLSLKALKQIIPLMYEGKRYDEACELCNFTIAKNQEKSEYLPLFEKTRFAKDISSPVVIRAICEFRKLLNDIIRRYGSVHKIHLELTRDFGISFSDRKKIIKEIEQNEQSRIKALETIKELKLEETSKNIQIVRLFEDQKGICPYSGLKMDLNRLDELVIDYIRPYNRSLDDSYSNKVLTFKKLSDLKQGKTPFEAFGEDEKLWAEINERIKEYNGKKRFKIFDKFFKDKKPFDFTEQTLQDTRWLTKLVASYLNEYLSFLPISEDENTALGYGEKGSKQHVILSSGMITQMLRNFWYLGFKNHKDYKNNAMDAIIVAFTTNSIIFAFNNFKKELDLAKAEFYANKISESDYLLKRKFLPPFSGFKEQALEKVKNIFVSHSLKIKNKGTLHDLTPLKIKELKNTYGDLDLAVKLGKIRKYNDKYYANANGSLVRADLFVDKKNKFHAVSIYKADFSTKKLPNKTPATTSNGETKEGIEMNENYNFCMSLYKNTPISVKIKGMKEPIICYYHGFNTSGSKITYKKHDNNYHNLSEDEMVVFRKNDKESIAVGKILEIKKYSISPSGELSLIENEERKWF

SEQ ID NO: 375 - protein, 759 aa, Campylobacter jejuni
MLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFESFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 376 - protein, 984 aa, Campylobacter jejuni
MVRILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLITPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNKTPFEAFGNDSAKWQKIEVLAKNLPTKKQKRILDKNYKDKEQKDFKDRNLNDTRYIARLVLNYTKDYLDFLPLSDDENTKLNDTQKGSKVHVEAKSGMLTSALRHTWGFSTKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 377 - protein, 1003 aa, Campylobacter lari]
MRILGFDIGINSIGWAFVENDELKDCGVRIFTKAENPKNKESLALPRRNARSSRRRLKRRKARLIAIKRILAKELKLNYKDYVAADGELPKAYEGSLASVYELRYKALTQNLETKDLARVILHIAKHRGYMNKNEKKSNDAKKGKILSALKNNALKLENYQSVGEYFYKEFFQKYKKNTKNFIKIRNTKDNYNNCVLSSDLEKELKLILEKQKEFGYNYSEDFINEILKVAFFQRPLKDFSHLVGACTFFEEEKRACKNSYSAWEFVALTKIINEIKSLEKISGEIVPTQTINEVLNLILDKGSITYKKFRSCINLHESISFKSLKYDKENAENAKLIDFRKLVEFKKALGVHSLSRQELDQISTHITLIKDNVKLKTVLEKYNLSNEQINNLLEIEFNDYINLSFKALGMILPLMREGKRYDEACEIANLKPKTVDEKKDFLPAFCDSIFAHELSNPVVNRAISEYRKVLNALLKKYGKVHKIHLELARDVGLSKKAREKIEKEQKENQAVNAWALKECENIGLKASAKNILKLKLWKEQKEICIYSGNKISIEHLKDEKALEVDHIYPYSRSFDDSFINKVLVFTKENQEKLNKTPFEAFGKNIEKWSKIQTLAQNLPYKKKNKILDENFKDKQQEDFISRNLNDTRYIATLIAKYTKEYLNFLLLSENENANLKSGEKGSKIHVQTISGMLTSVLRHTWGFDKKDRNNHLHHALDAIIVAYSTNSIIKAFSDFRKNQELLKARFYAKELTSDNYKHQVKFFEPFKSFREKILSKIDEIFVSKPPRKRARRALHKDTFHSENKIIDKCSYNSKEGLQIALSCGRVRKIGTKYVENDTIVRVDIFKKQNKFYAIPIYAMDFALGILPNKIVITGKDKNNNPKQWQTIDESYEFCFSLYKNDLILLQKKNMQEPEFAYYNDFSISTSSICVEKHDNKFENLTSNQKLLFSNAKEGSVKVESLGIQNLKVFEKYIITPLGDKIKADFQPRENISLKTSKKYGLR

SEQ ID NO: 378 - protein, 372 aa, candidate division
DNESAINQIAYILTTQKADEGIRAELDSLPLSDKAKKAIVKIKPTNFKAFGHLSIKALQKITPHILEGMTYDKACEAAGYDFKKQSASLEQITNPVVKRAITQTLKVVRAIERKYGKPYFIKVETARDLAKNFKDRNAIKKENEENQGYNEDIKSIITNGYEASPKTKGGKQLLNHLKEFNVRLNKNADFNGQQIIKVKLYREQQGKCLYSGNPIDFETMLRDDNAYQVDHIVPFSRSNNDGITNKVLVFTEENQKKADRTPFEYFGTDERRWEKFVALVETTYKTRDVKTSDKATNAINYEYNGYAMKKKQNLLLQDYKNDSWNVRALNDTRYITRFIQNYLRQNVDFAEGEEKQRIIAPNGTTTAYLRKR

SEQ ID NO: 379 - protein, 1117 aa, Capnocytophaga ochracea
MKHILGLDLGSNSIGWAFVQQDFENKQGKIIATGSRIIPMDQGILGDFERGNTVSQTAERTTYRSMRRLRERHLLRRERLHRVLHLLGFLPPHYDAQIDFTKRYGKFIDNAEPKIAYNNGNFIFMNSFNEMVEDFKKHQPQLFYKKSNGEESRIPYDWTIYYLRKKALSQKITQQELAWLILHFNQKRGYYQLRGEEETENPNKEVAFHSLKVVDVEAEAPNKKGEIWYTIRLENGWIYRRTSKNPLDDWKGKTRDFIVTTDLNDDGTIKLDKEGKEKRSFRAPDENDWNLLKKKTEHDIDFSGKPVGTYIYDHLLQNPNQKIKGKLVRTIERKYYKDELKAILAKQIALQPELFTETLLADCIRELYRKNETQQQNLLSKDFLHLFVEDIIFYQRPLCSKKSTIANCTLEKRSYIDKETNERKDAPIKVCAKSNPYYQEFRVLQWLQNLRIYEIETDREVTAEFIETPQDYEALFNFLMSQKEIDNEGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYSGGQANFFDEIHIELGRELKKTAEERKQLSDKNQENENTNLRIKKLLAELKEDASIQNVRPYSLVQQELLKIYEEGVFSSTDEIEEDIQKIRKKVEPTPPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKCISEILSKIVRSDEKDEGVNSKNIIPCTGKITTALKQDWGLNDVWNELILPRFERMNQLTQTQLFTSYNDRLQKNLPTVPIEYSQGFQKKRIDHRHHAMDALVIACATREHINYMNNQHALDKSKDKKEKQQSRIDLHPL

SEQ ID NO: 380 - protein, 303 aa, Capnocytophaga ochracea
MSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKEKRTYATIPLNEVIERQKQGLPSVPERNEKGEPLLFSLSPNDLVYVPMEGEIAETIDFNNLSKEQKERIYKTVSFTGNQCFFVQEAVASPIVNKMEYSPLNKMERDILGIMIKEVCVKLKVDRLGNIIKA

SEQ ID NO: 381 - protein, 1471 aa, Capnocytophaga sp.
MCKYFYIKNFITFVLSKSIIPMKHILGLDLGSNSIGWAFVQQDFENKQGKIIATGSRIIPMDQGILGDFERGNTVSQTAERTTYRSTRRLRERHLLRRERLHRVLHILGFLPPHYDAQIDFTKRYGKFIDNAEPKIAYNNGNFIFMNSFNEMIEDFKKHQPQLFYKKSNGEESKIPYDWTIYYLRKKALSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDAPIKVCAKSNPYYQEFRVLQWLQNLRIYEIETDREVTAEFIETPQDCEALFNFLMSQKEIDNKGLLKYFLFAKNPQIKDKAAKSELKKWLTTYRWNYVYDAADNSSKKYPMNETGYELQRYLQKVEGLPANFLTFDITYQLWHLLYSVKDKVEFEKALKKFAKKKQLDKTSFVDSFKNFKPYPNEYGSFSEKAIKKLLPLMRFGNHWDFNRIDVSTQKRIDDLINGVANEDIRTIIREKAEKYQLNSETCFQDLPLWLAQYVVYNRHAEATDIEKWTSVSDLEAYLEDFKQHSLRNPIVEQVVTETLRVVRDIWQQYGGGQANFFDEIHIELGRELKKTAEERKQLSDKNQENESTNLRIKKLLAELKEDASIQNVRPYSLVQQELLKIYEEGVFSATDEVEEDIQKIRKKAEPSKADLQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNKLILPRFERMNQLTQTQLFTSYNDRLQKNLPTVPIEYSQGFQKKRIDHRHHAMDALVIACATREHINYMNNQHALDKSKDKKEKQQSRIDLRTILCEKKNNNWQFKKPWSTFTQEAKEALEHIVVSFKQNLRVINKATNYYEKWEEKNGVLVKKKVKQEGTNWAIRKPLHKETVSGKIVLDRKIGKDKILTATRKAVDITFTEKIISSITDTGIQKILLNYLKYKGSPEVAFSTEGLEELNKNIAQYNNGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 382 - protein, 1450 aa, Capnocytophaga sp.
MKHILGLDLGSNSIGWAFVQQDFENKQGKIIATGSRIIPMDQGILGDFERGNTVSQTAERTTYRNTRRLRERHLLRRERLHRVLHILGFLPPHYDSQIDFTKRYGKFIDNAEPKIAYNNGNFIFMNSFNEMIEDFKKYQPQLFYKKSNGEESKIPYDWTIYYLRKKALSQKITQQELAWLILHFNQKRGYYQLRGEEETENPNKEVAFHSLEVVDVEAEAPNKKGEIWYTIRLENGWIYRRTSKIPLDDWKGKTRDFIVTTDLNDDGTIKLDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTPIKVCAKSNPYYQEFRVLQWLQNLRIYEIETDREVTAEFIETAQDNEALFNFLMSQKEIDNESLLKYFLFAKNPQIKDKVAKSELKKWLTTYRWNYVYDAADNSSKKYPMNETGYELQQYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSETCFQGLPLWLAQYVVYNRHAEAADIEKWTSVNDLEAYLEDFKQHSLRNPIVEQVITETLRVVRDIWQRYGGGQANFFDEIHIELGRELKKTAEERKQLSNRNQENENTNLRIKKLLAELKEDASIQNVRPYSPVQQELLKIYEEGVFSATDEVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITANKEVTIFTEEQYKEFVKKHYANNSAKQQKLLLNEIPEKMVARQLNDTRYISKYISEILSKIVRSDEKDEGVNSKNIIPCTGKITTALKQDWGLNDVWNELILPRFERMNQLTQTQLFTSYNDRFQKNLPTVPIEYSQGFQKKRIDHRHHAMDALVIACATREHINYMNNQHALDKSKDKKEKQQSRIDLRTILCEKKNNNWQFKKPWSTFTQEAQEALEHIVVSFKQNLRVINKATNYYEKWEEKNGVLVKKKVKQEGTNWAIRKPLHKETVSGKIVLDRKIGKDKILTATRKSVDITFTEKIISSITDTGIQKILLNYLKYKGSPEVAFSAEGLEELNKNIAQYNDGKKHQPIYKVRIFEEGSKFPLGETGAKATKYVEAAKGTNLFFGVYQGKGKRTYATIPLNEVIERQKQGLPSVPERNEKGEPLLFSLSPNDLVYVPMEGEIAETIDFNNLSKEQKERIYKTVSFTGNQCFFVQEAVATPIVNKIEYSPLNKMERDILGTMIKEVCIKLKVDRLGNITKA

SEQ ID NO: 383 - protein, 1435 aa, Capnocytophaga sp.
MKNILGLDLGTTSIGFAHIVEDENKEKSEIKELGVRIVSLATDEQSDFEKGKSISTNANRTLKHGARLNLDRYQQRRKFLIDLLQKANLITSASILAENGKNTTHSTWQLRAKAVTERIEKEEFARVLLAINKKRGYKNSRKTKTEDEGQAIDGMAIAKCLYDENLTPGQLSLQLLQQNKKLLPDFYRSDLQKEFDLVWNLQKQFYPDILTDSFYKELQGKGKDATSKAFSKRYHFDTAENKGSKESVRLQAYQWRAEAISKQLSKEEVAYVLTEINNNLNNSSGYLGAISDRSKELYFNRQTVGQYLYAQLQENRHNSLKNKVFYRQDYLDEFERIWETQASFHKELTDELKKQIRDVVIFYQRKLKSQKGLVSFCEFESKEIEIEKDGKAITKSIGARVVPKSSPLFQEFKIWQILNNVTCKRKGIRKKKSSAKSTELDLFNEPSQSIFSLDMECKQLLFDELNLKGDLKSDKVLKLLGYSPQEWEINYNQLEGNRTQKSLYEAYLKIIEIEGYEVKDILQIKSTKDDWSLDESPLSASEIRERVKVIFQTLGICTKILYFDPLLPVKEFEQQYSYQLWHLLYSYESDDSTSGNETLYRILEKKYAFKREHATILANVALQDDYGSLSTKAIRKIYPYIKENQYSTACELAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISEKLQKQFGIKNPTKSDIIRYRLYQELEHNGYKELYTNTYIAPDVLFSKNIDIEHIVPKARVFDDSFSNKTLAFKEFNIKKGESTAFDYITSLNCEGELNQYLTRVENAYKTKSISLTKYKNLLKKASEIGDGFINRDLRDTQYIAKKAKEILFQVTKNVLSTSGSITDRLREDWGLVDVMKELNMPKYQSLGLTEVEERKDGNKVTVIKDWTKRNDHRHHAMDALTVAFTKPSYIQYLNHLNARKDENNKNYSVILAIEKKETIKVPINNGKNKRVFIEPILNFRQVAKKHLEEIFISHKAKNKVVTKNINKPAGTDKQQITLTPRGQLHKETIYGKYQYYVNKEEKVGVKFDERTITKVSNPLYREALLKRLQANDNDPKKAFAGKNALSKNPIYLDEAKTKTLPEKVNLTYLEEDFSIRKDISPDNFKDLKSIEKVIDQGVKRILIKRLQAYDNDPKKAFVDLEKNPIWLNKEKGIAIKRVTISGVSNAQPLHIGKDHLGKTTLNKEGKEVPVDYVSTGNNHHVAIYRDKEGNLQEQIVSFFEAVVRAQQGLPIIDKNYKQAEGWQFMFTMKQNEMFVFPNEATGFNPAEIDLLDPKNKKLISPNLFRVQTISIVKYGNSVVRDFKFRHHLETTLQDDKILQGITFQQIKSLEPLRNIVKVRINHLGDIVNIGEY

SEQ ID NO: 384 - protein, 1432 aa, Capnocytophaga sp.
MKNILGLDLGTTSIGFAHIVEDENKEKSEIKELGVRIVSLTTDEQSDFEKGKSITTNANRTLKHGARLNLDRYQQRRKYLIDLLHKANLITPSSILAENGKNTTHSTWQLRAKAVTERIEKEEFARILLAINKKRGYKSSRKAKTEDEGQAIDGMAIAKRLYDENLTPGQLSLQLLQQNKKLLPDFYRSDLQKEFDLVWNFQKQFYPDILTDIFYKELQGKGKDATSKAFSKRYHFDTAENKGSKESVRLQAYQWRAEAVSKQLSKEEVAYVLTEINNNLNNASGYLGAISDRSKELYFNRQTVGQYLYAQLQENRHNSLKNKVFYRQDYLDEFERIWETQALFHKELTDELKKQIRDVVIFYQRKPKSQKGLISFCEFESKEIEIEKDGKTITKNIGARVVPKSSPLFQEFKIWQILNNVICKRKGIRKKKISAKTTQLDLLNESSQTIFSLDMECKQLLFDELNLKGDLKSDKVLKLLGYSPQEWEINYNQLEGNRTQKALYEAYLKIVEMEAHDVKDILQIKSTKDDWSLDESPLSASEIRESVKAIFQALGICTKILYFDPLLPVKDFEEQDSYQLWHLLYSYESDDSTSGNETLYRILEKKYAFKREHARILANVALQDDYGSLSTKAIRKIYPNIKENQYSTACEMAGYKHSKLSLTTEELEARELKNIIPLLKKNALRNPVVEKILNQMINVVNALIEKNSERDAEGKITKYFHFDEIRIELARELKKNAQKRYEMTQNINKAKSEHQKISEILQKEFGIKNPTKSDIIRYRLYKELEHNGYKELYTNTYIAPDVLFSKNIDIEHIVPKARVFDDSFSNKTLAFKDFNIKKGESTAFDYITSLKNEEKLNQYLARVENAYKTKNISPAKYKNLLKKASEIGDGFINRDLRDTQYIAKKAKEILFQVTKNVLSTSGSITDRLREDWSLVDVMKELNMPKYQSLGLTEVEERKDGNKVTVIKDWTKRNDHRHHAMDALTVAFTKPSYIQYLNHLNARKDENNKNYSVILAIEKKETIKVPTNNGKNKRVFIEPIPNFRQVAKKHLEEIFISHKAKNKVVTKNTNKPAGTNKQQITLTPRGQLHKETIYGKYQYYVNKEEKVGVKFDKETIAKVSNPLYREALLKRLQANDNDPKKAFTGKNALSKNPIYLDEAKTKTLPEKVNLTYLEEDFSVRKKIVPKNPTSKEFVPNLKSIEKVVDEGVRNILIERLRVYNNDPEKAFVDLEKNPIWLNKEKGIAIKRVTISGVNNAQPLHIGKDHLGKTTLNKEGKEIPVDYVSTGNNHHVAIYRDKEGNLQEQIVSFFEAVVRTQQGLPIIDKTYKQEEGWQFLFTMKQNEMFVFPNEATGFNPAEIDLLDPKNKKQISPNLFRVQKIATKDYFFRHHLETNVETDNVLKNTTWKREGLSGLKDIVKVRINHLGDIVSIGEY

SEQ ID NO: 385 - protein, 1426 aa, Capnocytophaga sp.
MKNILGLDLGTTSIGFTHIVEDENKEKSEIKELGVRIVSLTTDEQSDFEKGKSISTNANRTLKHGARLNLDRYQQRRKFLIDLLQKANLITSSSILAENGKNTTHSTWQLRAKAVTERIEKEEFARVLLAINKKRGYKSSRKAKTEDEGQAIDGMAIAKRLYDENLTPGQLSLQLLQQNKKLLPDFYRSDLQKEFDLVWNFQKQFYPDILTDSFYKELQGKGKDATSKAFSKRYHFDTAENKGSRESVRLQAYQWRAEAISKQLSKEEVAYVLTEINNNLNNASGYLGAISDRSKELYFNRQTVGQYLYAQLQENKHNSLKNKVFYRQDYLDEFERIWETQASFHKELTEELKKQIRDVVIFYQRKLKSQKGLISFCEFESKEIEIEKDGKTITKSIGARVVPKSSPLFQEFKIWQILNNVTCKRKGIRKKKSSAKSTELDLFNEPSQTIFSLDMECKQLLFEELNLKGDLKSDKVLKLLGYSPQEWEINYNQLEGNRTQKALYEAYLKIVEMEAHDVKDILQIKSTKDDWALEESPLSASEIRERVKAIFQTLGICTKILYFDPLLPVKEFEEQDSYQLWHLLYSYESDDSTSGNETLYRILEKKYAFKREHATILANVTLQDDYGSLSTKAIRKIYPYIKENQYSTACEKAGYKHSKLSLTTEELEARELKNIIPLLKKNALRNPVVEKILNQMINVVNALIEKNSERDAEGKITKYFHFDEIRIELARELKKNAQERYEMTQNINKAKLEHQKISGILQKEFGIKNPTKSDITRYRLYQELAHNGYNDLYTNTYIPKELLFSKNIDIEHIVSKARVFDDSFSNKTLAFREFNIKKGESTAFDYITSLNNEEELNQYLNRVENAYKTKNISPAKYKNLLKKASEIGDGFINRDLRDTQYIAKKAKEILFQVTKNVLSTSGSITDRLREDWGLVDVMKELNMPKYQSLGLTEVEERKEGNKVTVIKNWTKRNDHRHHAMDALTVAFTKPSYIQYLNHLNARKDKNNKNYSVILAIEEKETIKVPTNNGKNKRVFIEPIPNFRQVAKKHLEEIFISHKAKNKVVTKNTNKPAGTDKQQITLTPRGQLHKETVYGKYQYYVNKEEKIGVKFDKETIAKVSNPVYREALLKRLQANDNDPKKAFAGKNALSKNPIYLDEAKTKTLTEKVNLTYLEEDFSIRKDISPDNFKDLKSIEKVIDQGVKRILIKRLQDYDNDPKKAFVDLEKNPIWLNKEKGIAIKRVTISGVNNAQPLHIGKDHLGKTTLNKEGKEIPVDYVSTGNNHHVAIYRDKEGNLQEQIVSFFEAVVGAQQGLPIVDKTYKQAEGWQFLFTMKQNEMFVFPNEATGFNPAEIDLLDPKNKKQISPNLFRVQKIATKDYFFRHHLETNVDTDNVLKNTTWKREGLSGLKDIVKVRINHLGDIVSIGEY

SEQ ID NO: 386 - protein, 1450 aa, Capnocytophaga sp.
MKRILGLDLGSNSIGWAFVEQDFENKQGKIIATGSRIIPMDQGILGDFEKGNTVSQTAERTTYRSMRRLRERHLLRRERLHRVLHILGFLPPHYDAQIDFTKRYGKFIDNAEPKIAYNNGNFIFMNSFNEMIEDFKKYQPQLFYKKSNGEESKIPYDWTIYYLRKKVLSQKITQQELAWLILHFNQKRGYYQLRGEEETENPNKEVAFHSLKVVDVEAEAPNKKGEIWYTIRLENGWIYRRTSKIPLDDWKGKTRDFIVTTDLNDDGTIKVDKEGKEKRSFRAPDENDWNLLKKKTEHDIDFSGKTVGAYIYDHLLQNPNQKIKGKLVRTIERKYYKDELKAILAKQIALQPELFTETLLADCIRELYRKNETQQQNLLSKDFLHLFVEDIIFYQRPLRSKKSTIANCTLEKRSYIDKETNERKDTFIKVCAKSNPYYQEFRVLQWLQNLRIYEIETDREVTAEFIETAEDYEALFNFLMSQKEIDNEGLLKYFLFAKNPQIKDKVAKSELKKWLTTYRWNYVYDAADNSSKKYPMNETGYDLQRYLQKVEGLPANFLTFDITYRLWHLLYSVKDKVEFEKALKKFAQEYQLDEASFVDSFKNFKPYPNEYGSFSEKAIKKLLPLMRFGNHWDFNRIDVSTQKRIDDLINGVANDEIRTIIREKAEKYQLNSESCFQGLPLWLAQYVVYNRHAEATDIEKWTSVSDLETYLEDFKQHSLRNPIVEQVVTETLRVVRDIWQQYGGGQANFFDEIHIELGRELKKTAEERKQLSNRNQENENTNLRIKKLLAELKEDASIQNVRPYSPVQQELLKIYEEGVFSSTDQVEEDIQKIRKKAEPTTPEIQRYKLWLEQKYKSPYTGEVISLTKLFTEEYEIEHIIPQSRYYDDSLSNKVICESAVNKLKTNQLGLEFIQNHHGEKVRITGNKEVTIFTEEQYKEFVKKHYANNSAKQQKLLLNEIPEKMVARQLNDTRYISKYISEILSKIVRSDEKDEGVNSKNVIPCTGKITTALKQDWGLNDVWNELILPRFERMNQLTQTQLFTSYNDRFQKNLPTVPIEYSQGFQKKRIDHRHHAMDALVIACATREHINYMNNQHALDKNKDKKEKQQSRIDLRTILCEKKNNNWQFKKPWSTFTQETKEALEHIVVSFKQNLRVINKATNYYEKWEEKNGVLVKKKVKQEGTNWAIRKPLHKETVSGKIVLDRKIGKDKILTATRKEVDITFTEKIISSITDTGIQKILLNYLNYKGSPEVAFSAEGLEELNKNIAQYNDGKKHQPIYKVRIFEEGSKFPLGETGAKATKFVEAAKGTNLFFGVYQGKEKRSYATIPLNEVIERQKQGLPSVPERNEKGEPLLFSLSPNDLVYVPMEGEIAETIDFNNLSKEQKERIYKTVSFTGNQCFFVQEAVATPIVNKMEYSPLNKMERDILGTMIKEVCIKLKVDRLGNITKA

SEQ ID NO: 387 - protein, 1437 aa, Capnocytophaga sp.
MKYIKYILGLDIGSNSIGWALIQLDLLQKTKRIIATGSRIIPMDQKVLSDFGKGITISPTAQRTSYRNARHCRERHLLRRERLHRVLHILGFLPTHYDKQIDFSKRYGKFVDNTEPKIAYNERKFLFMDSFQEMLADFKIHQPDLFYTKKNGEESKIPYDWTIYYLRKKALSRKISKEELAWIILNFNQKRGYYQLREEEEENKENDFEIISSKIISVIKKDKDKKYNKYWYDIILENGLVYQAAFYNDFVYNWINQDREFIIERISLKNGTEKVKLSYLPTFDEIDKMDKKEQDKYYKKIKIKTENSIGNKTVGCYIYDHILQNPNEKIKGKLVRTIERKYYKEELKAILEKQVALQPELFTDQLFADCIRELYSKNEAQQRNLAARDFVHLFVEDIIFYQRSLRRQKSTLANCSLESRSYIDKDSHTRKEAPLKVCPKSNPYYQEFRVLQWLQNLKIYEIDTDQEVTHEFIKTLEDKQQFFDFLMNQKEIDCEELLKYFLNQTYPNAREKALKSELKKWKDTYRWNYVYDIGEKSSKKYPMNETRYELKRHLEKVANLPDDFLSSEVEYLLWHLIYSVKDKVAYEKGLKTFAQKHHLDKDSFVESFKKFKPYPSEYGSFSEKAIRKLLPLMRFGSYWDFNHIDKNTQKRIEDLITGVENEEIRTILREKAEKYQLEKETDFQDLPLWLAQYIVYNRHAEASSLEKWTSVNDLETYLNEFKQYSLRNPIVEQVVMETLRVVRDIWQQYGQGQASFFDEIHIELGRELKKTAKEREKLSKQNQKNEDINLSIKEKLKELEKYNTRAYSITHQEKYKLWLEQKHISPYTGQIISPENLFTDNYEIEHIIPQSRFFDDSLSNKVVCESIVNKAPYKDRQLGLEFIKNQGGRIVKELSTENKTIKIFTEEQYRTFIKEHYSNNPEKTKKLLLEEIPEKMVARQMNDTCYISKFISEILSKIVRSDEQDEGVHSKNVILCTGKITSALKQDWGVNDVWNDLILPRFERMNDLTQSTLFTTYNEKYQKYLPTVPMEYSNGFQKKRIDHRHHAMDAIIIACATREHINYINNQHALEKGKDKKEKQKEHDKLREKLCIKKDNKGSEENYSWIFKKPWDTFTQEVQAALEGIVVSFKQNLRVINKATNYYERWVEENGKYIKKMVKQEGTNWAIRKPLHEETISGKIYLDREEITKNDILTATRKTVDSSFDEKRIKKITDTGIQKILLNYLKYKGSPEIAFSPEGLEELNKNLSIYNDGKPHKPIYKVRIYEKGSGRFALGEKGRKYKKYVQGAPNLYFGIYQGANKRSFATIPLNEVIERQKQGRPSIPEYNEKGDPLLFSLSPNDLVYVPVEGEIIEDIDFQNLSKEQKERIYNVNDFSSTCYFTPNRIAKAIFPKEVDLQRKGDKLPGSYDTKTASLEGIQIKEVCIKLKIDRLGNISKA

SEQ ID NO: 388 - protein, 1140 aa, Catellicoccus marimammalium
MKNMTKVNVGLDVGISSAGWSVINAETNQILESGVRLFSGSDADENVNRRNQRQGRRLFRRRKLRIQEAKKYLENVFQLKDIEPKDEWNPYEIRVRALNEKVSKEELSIALLNIVKHRGISYELEDVTDEEGTNTQSFQSGLDYNRRLLKTKTVGEIQYDRLQKYGQVRGQIQTEDGLLINIFPTKNYVEEVERILETQKKYHPEIDDVFIEKIISFVTRKREYFVGPGNEKSRTDYGIYRENGETLDNLFEILIGKDKFYPEEYRAAGSSYTAQIFNLLNDLNNLRIPTTEDHHLTKAQKEEIITELKNTSRLSGGMLKLISKVTKAPKEEISGYRKDEKDKPDLHSLAYYRKQKNMLEKEGIQIADFSEELLDELATMMTLNTEPGEIRKQLNKITNQYDILTPEVIEVLVKNHTAFVATSNHKWHRFSLKLMKEFIPELLETSKEQSTILCERGFIQNRASYLDENHHFNYAELRENLYNPVVRKSTCEMLKVFTAIQEKYPNIQNVIVELPRETNEDEQKRKIKKINDNNAKRKKEILKEAQAQSGLSEEALEEKLLKTKGLYLKLMLWYEQEGKCVYSGQEIPLSDLLQNKGGYEVDHIIPISISFDDRLCNKVLVRQQLNSQKSNQTPFEYMTTHTDGHLSFHELKELVGKNKRFSKEKRELLLAEIYSNDIETRKRFINRNLVDTSYTARIVLNALQQYKKENQLSMNVSVVRGAMTNILRKKVKLDKTRETFHHHAIDASLMAVIPNIEFFKERKEWLPKSANEEVVEVEVSEEETMPEKEFKVKMRLPESFIQDVQILQRNSFAKEEVSGPQTRERNLKIKFSHQVDQKMNRKVADDTIYGTRQAQLGKDKKEETYVIGKIKDIYNYDEYVRFKKRYDKNKESFLMYHHDPQTFEKLEEILAQYPEYIEDEKGKKKKVSPFALYREENGPVTKYAKKNNGPVIKQLKYYDSKLNRKIDISHKYSTKNRQVVLQSLKPYRTDVYRNQDTGEYTLVGIDQNDGKFVNGHYGIPKSRYEEIKANNKLSEHDEFVFSLYKNSMVKVIDENGESIVVRYLSRSMPNRKNNAEIKPVEKYQFEDGEVVPVYGKCRKQMQTVFVKKGWTLLKGNTDILGNTYFVEKESENPKKMIDDK

SEQ ID NO: 389 - protein, 1419 aa, Chryseobacterium sp.
MMIKNILGLDLGTNSIGWALIKQNFENKYGEILGMGSRIIPMSQDVLGEFGKGNSVSQTAARTGYRGVRRLRERFLLRRERLHRVLNVLNFLPEHYASQIDFEKRFGKFKYETEPKLAYNNDGFFFKNSFDEMLGDFKDHQFHLLENGRKVPYDWTIYYLRKKALSQKIEKEELAWILLNFNQKRGYYQLRGEDFEEEKDRVFVRLKVDRVVDSGENIKGKILYDVYFENGWKYEKQIVKTEDWIGRTKEFIVTESILKNGDTKRTFKAVDSEKDWIAIKTKTEQEIDKSHKTVGAYIYEALLQNPKQKIKGKLVRTIERKFYREELKKILERQKEFHPELQSDDLYNDCIRELYRNNEAHQITLSKKDFVHLLLNDLIFYQRPLRSQKSSVSNCTLEFRKYKDENGVEHAQYLKTIPKSNPYYQEFRVWQWMFNLNIYRKDDDTNVTKEFLSSTEDYETLFEFLNNRKEVDQKALLRHFKLNEKTHRWNYVEDKKYPCNETKTMISTRLEKVENYPSDFLTREMEQNIWHIIYSVNDKIEYEKALKSFAHKNNLDENSFFEAFKKFPPFKSEYGSFSEKAIKKLLPLLRLGKYWNWESIDRKSQGRIEKIITGEFDGNIKDKVREKAIHLTAENDFQGLQLWLAQYIVYGRHSEASMIGKWNSADDLEEFLKGFKQHSLRNPIVEQVITETLRVVKDIWLKYGNGAKDFFSEIHIELGREMKQTKDERVDATKRITENENTNLRIKALLAEMMNDNSVENIRPYSPMQQEILKIYEDGILKSDIEIDDDILKISKTAQPSSSDLKRYKLWLEQRYKSPYTGQIIPLNKLFTSEYEIEHIIPQSRYFDDSFSNKIICESAVNKLKDNYIGLGFIKQFGGMIVECGFGKSVEIFKAEEYEDFVKKHYANNRSKRNKLLLEEIPEKMIDRQLNDTRHISKYISGVLSNIVRQEDGTDEGVNSKNIVPGNGKITTQLKQDWGLNDVWNELILPRFERMNQLTNSTDFTSWNKNHQKFLPTVPIEFSKGFSKKRIDHRHHAMDALVIACATKDHINLLNNQSAKSDTKRYDLKRKLMKFERVVYSHSKTGEKIEKEVPKQFLKPWDNFTVDAKNKMETIIVSFKQNLRVINKATNHYEKWIEKDGIKRKELIKQEGTNWAIRKPMHKETVSGKVDLPGIKIPKGKILTATRKSLDTSFDLKTINSITDTGIQKILKNYLEFKGSSELAFSPEGIEDMNKNIEKFNDGKPHQSINKVRIFELGSKFSVGQTGNKKDKYVEAAKGTNLFFAVYEDKNGKRSYETIPLNEVIERQKQGLDSVSFKNKEDFLLCPNDLVYVPSEDELENIYNIDFKNLTTEKTGNIYKVVSFSGNQIFFIRQDIAISIVNKAEFSTLNKMERAIDGSMIKENCIKLKIDRLGNIAKI

SEQ ID NO: 390 - protein, 1065 aa, Clostridium perfringens
MNKDINYALGLDIGITSVGWAVINLDLNRIEDLGVRIFNAAENPKDGSSLALPRRLARGRRRLLRRKAYRVERVRKLIVKNNILTKEELEGLFKNKEVIDVWEARVKGLDYKLSREEWAKILINFCKRRGFKSNRKNETKDKEAGQILSSISYNIEKMKETNSRTIGEYIYNEVKNSDDSYAPLRNKFGEYKMCVSRDVLREEIHTLFEKQRELGNNFASDEIEDKYFEIFNSQRPFSNFEDLEKLVGFCTFERKKHKRAPKHCISSEEFTLYEGINKLSIIKDGEKRKLSEEERTLVVNEAFNKKEIKYTTLRKLLGLSEDELFSTLTYSIDKDISKTENTKFVSLKGYHEIKRAIEKGVSKKAWQDIENNRNLLNDIAYVLTLGKTDDEIEKQLRLRNVPEELFESLLDMSFSKFNNLSIYALEKILPFMKEGYQYNEACEKAGYNFKAIYEGVRTKKLPVIEIDEIVNPVVNRALAQTRKVINSVIDKYGSPVRINIELARDLAKNFKDRKLIEKEQKENRANLDKIRENLRELMDKEPTAVEVLKYRLWEQQRGECAYTQSQIALERLFSPGYCEIDHIIPFSRSFDDSLSNKILVLGSENQRKGNKIPYEYFGEDSERWNSFEIWVKGSYLNYKKKANLLKKKFTEEEQRDWKARNLQDTKYICRYISNFVNNRLEFKESENKQKVITVNGRATAYLRSRWGLNKVREDGDKHHALDAAVVGVTTQGMVQKISKYSKAHELYTVRKNDEFVDVETGECVDVDEYKEIRKDILPRPWRGFSEELKLRLSDNPLEELKKLPIETYNEEFIKENVKPIFVSRVPFRKISGKLFKETIYSERAFKDGYFVSKKSLVDLKRGDLDNFYNYECDKKLYDAISERMKEFNYNGKKAFESPFRKPTKSGKEGPVVRSVKIKSAAPFKDGIPMNEGLVAKEGMVRIDIYEKEGKYFVVPVYRYQLAKGIVPKRAAIAGKSELKWPIMDQTYNFKFSIFKNDLIEIKYAKKDGYFGYYDGFDRHTASLVIENHDNSDRYRGIGVKTGVVEFNKYEVDVLGNYHKVNLGGN

SEQ ID NO: 391 - protein, 1099 aa, Corynebacterium accolens
MSLSYRVGIDVGTYSLGCTAIEVDDNDQPVNILSSVSLIHDSGLDPDQQKRAVTRLASSGVARRTRRLYRRRRRRMINLEKFLTSQGWETRPFEHYSDPYLPWNARVALVNGYISDDAQRGMYLSIAFRHIANHRGWRNPYWKVSSLYSPDKPSDAFEQIRKELEESTGHKIPETVTVGQLISFAQFGKDRLRGGGKKKDEKKPQEQVNQAVISARLHQIDHAREINEICRVQKIDDALRKQILDLVFAAESPKGAQIGRVGKDPLQPKLPRALKASDAFQQYRIVALAGNLRIYRDGVSTPLDRDEKLIVFNYLINLSHKEEPSWLKVAEVLNIDRGQLHGTATMTDDGERAGAAPPVHDTNRTILGCKIKPLVHWWEGANDDERAAMLKALSNSEVEDFDSPAGAQTQAFFANLDESEQEKLDSLHLPIGRAAYSEDTLMRLTSRMLDENLDLYEARLAEFDIPKDWAPPAPRIGEPVGNPAVDRVLKGVARWLEAAADEWGAPKSVVIEHVRDGFISKSKANEIDRANNARHKRNRELFKQMQENLGIDGKLRSSDLWRYQSVQRQNCQCAYCGSPITYTTCEMDHIVPRAGEGSTNTRDNLVATCHRCNLAKKNIPFAVWAAQTNIPGVSVKEALDRTRHWSEDSGMTSKDFKKFRKNVCDRLKRTVVDEPLDARSMESVAWMANELRGRVAQRFQEENTVVNVYRGELTAEARRAAGISDKLRFIDGTGKSRLDRRHHAVDAAVVAFTQNYVAETLAIRSNKKREAQLLQAAEQWKEFTGSDAEHRAAWNAWLPKMQKLAVLLQKALDEDRIAVTSNLRLRLGNGRAHEDSIGELKTIRVGDAISVTDIDRASSEALWCALTREPDFDENNGLPENPDRRIRIHGTWYDAEDDIEVFPVGAGAIKVRGGYAELSRFHHARIYKIPGKKAPVYCMLRVYNADLIRHRHEDLFSVEIKPQTMSVRQAEPKLRKALAENTAEYLGWLVTDDELVIDTSNFNTGQIAEMQSELGQVRRWRLDGFYSPSTLRLRPLQMSAEGLREDTSIGAKKIIDRPGWLPAINKLFGEGHVTVVRRDALGRARLTSNAHLPISWKAE

SEQ ID NO: 392 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVWVDGEKRILSVEEKNLVFDHLVNLTPKKEPEWVTIAEILGIDRGQLIGTATMTDDGERAGARPPTHDTNRSIVNSRIAPLVDWWKTASALEQHAMVKALSNAEVDDFDSPERAKVQAFFADLDDDVHAKLDSLHLPVGRAAYSEDTLVRLTRRMLSDGVDLYTARLQEFGIEPSWTPPTPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRATWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 393 - protein, 1084 aa, Corynebacterium diphtheriae
MKYHVGIDVGTFSVGLAAIEVDDAGMPIKTLSLVSHIHDSGLDPDEIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDGPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMQRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSPDFKKFTKAVVERFQRATMDEEIDARSMESVAWMANELRSRVAQHFASHGTTVRVYRGSLTAEARRASGISGKLKFFDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHKETIGKLSKVKLGSQLSVSDIDKASSEALWCALTREPDFDPKEGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFSPSKLRLRPLQMSKEGIKKESAPELSKIIDRPGWLPAVNKLFSDGNVTVVRRDSLGRVRLESTAHLPVTWKVQ

SEQ ID NO: 394 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLKSATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 395 - protein, 1084 aa, Corynebacterium diphtheriae
MKYHVGIDVGTFSVGLAAIEVDDAGMPIKTLSLVSHIHDSGLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 396 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDSFQRYRIAALISNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVRDGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKELAPELSKIIDRPGWLPAVNKLFSEGNVTVVRRDSLGRVRLESTAHLPVTWKVQ

SEQ ID NO: 397 - protein, 1084 aa, Corynebacterium diphtheriae
MKYHVGIDVGTFSVGLAAIEVDDAGMPIKTLSLVSHIHDSGLDPDKMKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKSIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNVQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRATMDEEIDARSMESVAWMANELRSRVAQHFASHGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 398 - protein, 1084 aa, Corynebacterium diphtheriae
MKYHVGIDVGTFSVGLAAIEVDDAGMPIKTLSLVSHIHDSRLDPDKIKSAVTRLASSGIARRTRRLYRRKRRRLQQLDKFIQRQGWPVIELEDYSDPLYPWKVRAELAASYIADEKERGEKLSVALRHIARHRGWRNPYAKVSSLYLPDEPSDAFKAIREEIKRASGQPVPETATVGQMVTLCELGTLKLRGEGGVLSARLQQSDHAREIQEICRMQEIGQELYRKIIDVVFAAESPKGSASSRVGKDPLQPGKNRALKASDAFQRYRIAALIGNLRVRVDGEKRILSVEEKNLVFDHLVNLAPKKEPEWVTIAEILGIDRGQLIGTATMTDDGERAGARPPTHDTNRSIVNSRIAPLVDWWKTASALEQHAMVKALSNAEVDDFDSPEGAKVQAFFADLDDDVHAKLDSLHLPVGRAAYSEDTLVRLTRRMLADGVDLYTARLQEFGIEPSWTPPAPRIGEPVGNPAVDRVLKTVSRWLESATKTWGAPERVIIEHVREGFVTEKRAREMDGDMRRRAARNAKLFQEMQEKLNIQGKPSRADLWRYQSVQRQNCQCAYCGSPITFSNSEMDHIVPRAGQGSTNTRENLVAVCHRCNQSKGNTPFAIWAKNTSIEGVSVKEAVERTRHWVTDTGMRSTDFKKFTKAVVERFQRVTMDEEIDARSMESVAWMANELRSRVAQHFASRGTTVRVYRGSLTAEARRASGISGKLEFLDGVGKSRLDRRHHAIDAAVIAFTSDYVAETLAVRSNLKQSQAHRQEAPQWREFTGKDAEHRAAWRVWCQKMEKLSALLTEDLRDDRVVVMSNVRLRLGNGSAHEETIGKLSKVKLGSQLSVSDIDKASSEALWCALTREPDFDPKDGLPANPERHIRVNGTHVYAGDNIGLFPVSAGSIALRGGYAELGSSFHHARVYKITSGKKPAFAMLRVYTIDLLPYRNQDLFSVELKPQTMSMRQAEKKLRDALATGNAEYLGWLVVDDELVVDTSKIATDQVKAVEAELGTIRRWRVDGFFGDTRLRLRPLQMSKEGIKKESAPELSKIIDRPGWLPAVNKLFSEGNVTVVRRDSLGRVRLESTAHLPVTWKVQ

SEQ ID NO: 399 - protein, 1069 aa, Corynebacterium matruchotii
MAAIAIDDDGKPTEILSAISLIHDSGVDPDSAKSAATRLATSGIARRTRRLYRRKRKRLAKLDKFISSQGWPLKEFEKYEDPFYPWRVRAELATTAITDQQELGEKLSIALRHIARHRGWRNPYSKVTALYTVTEPSDAFLAMQEECAKQLGRTIPETITVGQLVTGMNLGKTRLRGENSLLAARPRQSDNANEIHTIAKVQGLSNELVRQIIDHVFAAESPKGSAAEQVGKDPLQPTKKRALKASDAFQQYRIAALIGNLRIRGGKGNRRLTTEETRLVFDYLRSLPAKQEPTWQLVAEQLKIDRGNLVGTAIMTDDGERAGAKPPVHDTNRIMENTKIKPLATWWKSADADARAAMVKALSNAEVDDFDSQAGAQVQEFFFGISDEDQEKLDGLHLPIGRAAYSEDTLDRLTKRMIGEGMDLYEARQAEFKISNDWAPPAPEIGERVGNPAVDRVLKATARWLNAAERQWGAPKSVNIEHVRAAFMSESSARELDRDNQQRAKRNVKVVAEMQEKLGIEGRPSRADVWRFQSIQRQNGKCAYCGAEISFKNSEMDHIIPQVGEGSTNTRDNLVAVCRECNSSKSNIAFAVWAENTSRPGVSVQKAIERTHHWVTDSGLRKPEFDKFRKQVCDRLRRKATDEPIDARSLESVAWMANELRSRIAQKFKDGDTKVRVYKGALTAEARRASGISGKLEFVDGKGKSRLDRRHHAVDAAVVAFTSNYVAETLALRSNMKFDQELRRKAPQWREFTGSDHVHQVEWTKWKYRMQALAELLNNALVQDRIVVMHNLRLRLGNGAAHEDTIGKLTRLKVGDAISTTDIDRASSEALWCALTRDPDYDPKTGLPENPNRTIRIHGTHLTASDEITVFPVAAASIPIRDGFAKLGSNYHHVRLFRVPSGKKYKYCLMQVYTVDLLKFRKEDLFTVELKPQTISVRTCEALLRKALANGTAEYLGWLVSDDELLIDTSSFDTPGIVKLREEYGPVNRWRLAGLTSVTRLNLRPLYLSKEGLKPNVNPEIKKIIDNRSWIITVNKLFSSGHVKIIRRDALGRPRLHSAAHLPICWEVK

SEQ ID NO: 400 - protein, 210 aa, Diplosphaera colitermitum
MSDILDKPIVLSLNRAWQVIGHRTVKQALVALNGGNADLPPALGLDIAYPKFDDGAWNFDRPLFLNPLPWSEWIELPVRDFDFAITTPRLRIRVPTVIVATQFAKMPVRIPRLTREAIFERDGGVCQYTGEHVGKHGGNLDHVVPRDRGGRDSFENLVWAKREINSLKANRLPHEAGLRLLRRPKAPAPLPASMTIREARHPDWRHFLTP

SEQ ID NO: 401 - protein, 1332 aa, Dolosigranulum pigrum
MQKNYTIGLDIGTNSVGWAVMKDDYTLIRKRMKVLGNTDIKKIKKNFWGVRLFDEGETAKETRLKRGTRRRYQRRRNRLIYLQDIFQQPMLAIDENFFHRLDDSFFVPDDKSYDRHPIFGSLEEEVAYHNTYPTIYHLRKHLADNPEKADLRLVYTALAHIVKYRGHFLIEGELNTENTSISETFEQFLDTYSDIFKEQLVGDISKVEEILSSKQSRSRKHEQIMALFPNENKLGNFGRFMMLIVGNTSNFKPVFDLDDEYKLKLSDETYEEDLDTLLGMTDDVFLDVFMAAKNVYDAVEMSAIISTDTGNSKAVLSNQMINFYDEHKVDLAQLKQFFKTHLPDKYYECFSDPSKNGYAGYIDGKTNQEDFYKYIEKVMKTIKSDKKDYFLDKIDREVFLRKQRSFYNSVIPHQIHLQEMQAILDRQSQYYPFLAENRDKIESLVTFRIPYYVGPLTVSDQSEFAWMERQSDEPIRPWNFDEIVNKERSAEKFIERMTNMDTYLLEEKVLPKRSLLYQTFEVYNELTKVRYTNEQGKTEKLNRQQKAEIIETLFKQKNRVREKDIANYLEQYGYVDGTDIKGVEDKFNASLSTYNDLAKIDGAKAYLDDPEYADVWEDIIKILTIFEDKAMRKKQLQTYSDTLSPEILKKLERKHYTGWGRFSKKLINGLRDEGSNKTILDYLKSDEGSSGPTNRNFMQLIRDNTLSFKKKIEDAQTIEDTTHIYDTVAELPGSPAIKKGIRQALKIVEEIIDIIGYEPENIVVEMARESQTTKKGKDLSKERLEKLTEAIKEFDGPSDVKVKDLKNENLRNDRLYLYYLQNGRDMYTNEPLDINNLSKYDIDHIIPQSFTTDNSIDNKVLVSRTKNQGNKSDDVPSINIVHKMKPFWRQLHKAGLISDRKFKNLTKAEHGGLTEADRAHFLNRQLVETRQITKHVANLLDSQYNTAEEQRINIVLLKSSMTSRFRKEFKLYKVREINDYHHGHDAYLNAVVATTIMKVYPNLKPQFVYGQYKKTSMFKEEKATARKHFYSNITKFFKKEKVVNEETGEILWDTERHLSTIKRVLSWKQMNIVKKVEKQKGQLWKETIYPKGDSSKLIPVKEGMDPQKYGGLSQVSEAFAVVITHEKGKKKQLKSDLISIPIVDQKAYEQHPTAYLEEAGYNNPTVLHELFKYQLFELEDGSRRMIASAKEFQKGNQMVLPLELVELLYHANRYDKVKFPDSIEYVHDNLAKFDDLLEYVIDFSNKYINADKNVQKIQKIYKEHGTEDVELTVESFVNLMTFTAMGAPATFKFYGESITRSRYTSITEFRGSTLIFQSITGLYETRYKLEDN

SEQ ID NO: 402 - protein, 921 aa, Enterococcus faecalis
MIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNRILFLEEKGFLRPRVLMKLPKYTLYEFPEGRRRLLASAKEAQKGNQMVLPEHLLTLLYHAKQCLLPNQSESLTYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 403 - protein, 1337 aa, Enterococcus faecalis; identical to SEQ ID NO: 115

SEQ ID NO: 404 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDANTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYQFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 405 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTALDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSTPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKNFKRFIRENCPDEYDNLFKNEQKDGYAGYITHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 406 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 407 - protein, 936 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETR

SEQ ID NO: 408 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKEVVKDMKAYWEKLYAAGLISQRKFQRLTKGEQGGLTLEDKAHFIQRQLVETRQITKNVAGILNQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 409 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENISVKEQFQQFMIIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILGYLIKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENLGKSDDVPSKEVVKDMKAYWEKLYAAGLISQRKFQRLTKGEQGGLTLEDKAHFIQRQLVETRQITKNVAGILDQRYNANSKEKKVQIITLKASLTSQFRSIFGLYKVREVNDYHHGQDAYLNCVVATTLLKVYPNLAPEFVYGEYPKFQTFKENKATAKAIIYTNLLRFFTEDEPRFTKDGEILWSNSYLKTIKKELNYHQMNIVKKVEVQKGGFSKESIKPKGPSNKLIPVKNGLDPQKYGGFDSPIVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 410 - protein, 1337 aa, Enterococcus faecalis
MKKDYVIGLDIGTNSVGWAVMTEDYQLVKKKMPIYGNTEKKKIKKNFWGVRLFEEGHTAEDRRLKRTARRRISRRRNRLRYLQAFFEEAMTDLDENFFARLQESFLVPEDKKWHRHPIFAKLEDEVAYHETYPTIYHLRKKLADSSEQADLRLIYLALAHIVKYRGHFLIEGKLSTENTSVKEQFQQFMVIYNQTFVNGESRLVSAPLPESVLIEEELTEKASRTKKSEKVLQQFPQEKANGLFGQFLKLMVGNKADFKKVFGLEEEAKITYASESYEEDLEGILAKVGDEYSDVFLAAKNVYDAVELSTILADSDKKSHAKLSSSMIVRFTEHQEDLKKFKRFIRENCPDEYDNLFKNEQKDGYAGYIAHAGKVSQLKFYQYVKKIIQDIAGAEYFLEKIAQENFLRKQRTFDNGVIPHQIHLAELQAIIHRQAAYYPFLKENQEKIEQLVTFRIPYYVGPLSKGDASTFAWLKRQSEEPIRPWNLQETVDLDQSATAFIERMTNFDTYLPSEKVLPKHSLLYEKFMVFNELTKISYTDDRGIKANFSGKEKEKIFDYLFKTRRKVKKKDIIQFYRNEYNTEIVTLSGLEEDQFNASFSTYQDLLKCGLTRAELDHPDNAEKLEDIIKILTIFEDRQRIRTQLSTFKGQFSAEVLKKLERKHYTGWGRLSKKLINGIYDKESGKTILDYLVKDDGVSKHYNRNFMQLINDSQLSFKNAIQKAQSSEHEETLSETVNELAGSPAIKKGIYQSLKIVDELVAIMGYAPKRIVVEMARENQTTSTGKRRSIQRLKIVEKAMAEIGSNLLKEQPTTNEQLRDTRLFLYYMQNGKDMYTGDELSLHRLSHYDIDHIIPQSFMKDDSLDNLVLVGSTENRGKSDDVPSKKVVKKMKAYWEKLYAAGLISQRKFQRLTKGEQGGLTLEDKAHFIQRQLVETRQITKNVAGILDQRYNAKSKEKKVQIITLKASLTSQFRSIFGLYKVREVNDYHHGQDAYLNCVVATTLLKVYPNLAPEFVYGEYPKFQAFKENKATAKTIIYTNLMRFFTEDEPRFTKDSEILWSNSYLKTIKKELNYHQMNIVKKVEVQKGGFSKESIKPKGPSNKLIPVKNGLDPQKYGGFDSPVVAYTVLFTHEKGKKPLIKQEILGITIMEKTRFEQNPILFLEEKGFLRPRVLMKLPKYTLYEFPEGRRRLLASAKEAQKGNQMVLPEHLLTLLYHAKQCLLPNQSESLAYVEQHQPEFQEILERVVDFAEVHTLAKSKVQQIVKLFEANQTADVKEIAASFIQLMQFNAMGAPSTFKFFQKDIERARYTSIKEIFDATIIYQSTTGLYETRRKVVD

SEQ ID NO: 411 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRENAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDKLIGKDFQGELRASGLSLSAQQYNLLNDLTNLKIDGEIPLSPEQKEYILAELMTKEFTRFGVNDVVKLLGVKKERLSGWRLDKKGKPEIHTLKGYRNWRKIFAESGIDLAMLPTETIDCLAKILTLNTEREGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANQETKVRVVNGSFTHTLRKKWGADLDKTRETHHHHAVDATLCAVTPFVKVSRYHYAVKEETGEKVMREIDFETGEIVDEMSYREFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIRKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 412 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFKKTGQPATNIFDRLIGKDFQGELRASGLSLSAQQYNLLNDLTNLKIDGEIPLSPEQKEYILAELMTKEFTRFGVNDVAKLLGVKKERLSGWRLDKKGKPEIHTLKGYRNWRKIFAESGIDLATLPTETIDCLAKVLTLNTEHEGIENTLAFELPELAESVKLLVLDRYKELSQSVSTQAWHRFSLKTLHLLIPELMNATSEQNTLLEQFQLKSDVRKRYSEYKKLPTKDVLTEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLSISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFANHETKVRVVNGSFTHTLRKKWGADLDKTRETHHHHAVDATLCAVTPFVKVSRYHYAVKEETGEKVMREIDFETGEIVDEMSYQEFKKSKKYERKTYQVKWPNFREQLKPVNLHPRIKFSHQVDRKANRKLSDATIYSVREKTEVKTLKSGKQKITTDEYTIGKIKDIYTVDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLYYEKEPKNIIK

SEQ ID NO: 413 - protein, 1150 aa, Enterococcus faecalis
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSKGEIYKVTLHILKKRGISYLDEDDTEAAKESQDYKEQVRKNAQLLTKYTPGQIQLQRLKENNRVKTGINVQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTPFVKVSRYHYAVKEETGEKVMREIDFETGEIVNEMSYREFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEIMPAENQFKQKPYNNGAINLNIAKYGKEGKKLRKFNTDILGKKHYLFYEKEPKNIIK

SEQ ID NO: 414 - protein, 1150 aa, Enterococcus faecalis; identical to SEQ ID NO: 183

SEQ ID NO: 415 - protein, 1150 aa, Enterococcus faecalis; identical to SEQ ID NO: 184

SEQ ID NO: 416 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMNNTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 417 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 418 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 419 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 420 - protein, 1339 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSEETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 421 - protein, 1340 aa, Enterococcus faecium
MKKEYTIGLDIGTNSVGWSVLTDDYRLVSKKMKVAGNTEKSSTKKNFWGVRLFDEGQTAEARRSKRTARRRLARRRQRILELQKIFAPEILKIDEHFFARLNESFLVLDEKKQSRHPVFATIKQEKSYHQTYPTIYHLRQALADSSEKADIRLVYLAMAHLLKYRGHFLIEGELNTENSSVTETFRQFLSTYNQQFSEADDKQTEKLDEAVDCSFVFTEKMSKTKKAETLLKYFPHEKSNGYLSQFIKLMVGNQGNFKNVFGLEEEAKLQFSKETYEEDLEELLEKIGDDYIDLFVQAKNVYDAVLLSEILSDSTKNTRAKLSAGMIRRYDAHKEDLVLLKRFVKENLPKKYRAFFGDNSVNGYAGYIEGHATQEDFYKFVKKELTGIRGSEVFLTKIEQENFLRKQRTFDNGVIPHQIHLTELRAIIANQKKHYPFLKEEQEKLESLLTFKIPYYVGPLAKKQENSPFAWLIRKSEEKIKPWNLPEIVDMEGSAVRFIERMINTDMYIPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMKQWLEDPELASMFEEIIKTLTVFEDREMIKTRLSHHEATLGKHIIKKLTKKHYTGWGRLSKELIQGIRDKQSNKTILDYLINDDDFPHHRNRNCMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVVALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPTKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 422 - protein, 892 aa, Enterococcus faecium
MTFKIPYYVGPLAKKQENSPFAWLIRKSEEKIKPWNLPEIVDMEGSAVRFIERMINTDMYMPHNKVLPKNSLLYQKFSIYNELTKVRYQDERGQMNYFSSIEKKEIFHELFEKNRKVTKKDLQEFLYLKYDIKHAELSGIEKAFNASYTTYHDFLTMSENKREMEQWLEDPELASMFEEIIKTLTVFEDREMIKTRLSHHKATLGKHIIKKLTKKHYTGWGRLSKELIQGIRDKQSNKTILDYLINDDDFPHHRNRNFMQLINDDSLSFKKEIKKAQMITDTENLEEIVKELTGSPAIKKGILQSLKIVDEIVGIMGYEPANIVVEMARENQTTGRGLKSSRPRLKALEESLKDFGSQLLKEYPTDNSSLQKDRLYLYYLQNGRDMYTGAPLDIHRLSDYDIDHIIPRSFTTDNSIDNKVLVSSKENRLKKDDVPSEKVVKKMRSFWYDLYSSKLISKRKLDNLTKIKLTEEDKAGFIKRQLVETRQITKHVAGILHHRFNKAEDTNEPIRKVRIITLKSALVSQFRNRFGIYKVREINEYHHAHDAYLNGVIALALLKKYPQLAPEFVYGEYLKFNAHKANKATVKKEFYSNIMKFFESDTPVCDENGEIFWDKSKSIAQVKKVINHHHMNIVKKTEIQKGGFSKETVEPKKDSSKLLPRKNNWDPAKYGGLGSPNVAYTVAFTYEKGKARKRTNALEGITIMEREAFEQSPVLFLKNKGYEQAEIEMKLPKYALFELENGRKRMVASNKEAQKANSFLLPEHLVTLLYHAKQYDEISHKESFDYVNEHHKEFSEVFARVLEFAGKYTLAEKNIEKLEKIYKENQTDDLAKLASSFVNLMQFNAMGAPADFKFFDVTIPRKRYTSLTEIWQSTIIHQSITGLYETRIRMGK

SEQ ID NO: 423 - protein, 1336 aa, Enterococcus hirae
MTKDYTIGLDIGTNSVGWAVLTDDYQLMKRKMSVHGNTEKKKIKKNFWGARLFDEGQTAEFRRTKRTNRRRLARRKYRLSKLQDLFAEELCKQDDCFFVRLEESFLVPEEKQYKPASIFPTLEEEKEYYQKYPTIYHLRQKLVDSTEKEDLRLVYLALAHLLKYRGHFLFEGDLDTENTSIEESFRVFLEQYSKQSDQPLIVHQPVLTILTDKLSKTKKVEEILKYYPTEKINSFFAQCLKLIVGNQANFKRIFDLEAEVKLQFSKETYEEDLESLLEKIGDEYLDIFLQAKKVHDAILLSEIISSTVKHTKAKLSSGMVERYERHKADLAKFKQFVKENVPQKATVFFKDTTKNGYAGYIKGKTTQEEFYKFVKKELSGVVGSEPFLEKIDQETFLLKQRTYTNGVIPHQVHLIELKAIIDQQKQHYPFLEEAGPKIIALFKFRIPYYVGPLAKEQEASSFAWIERKTAEKINPWNFSEVVDIEKSAMRFIQRMTKQDTYLPTEKVLPKNSLLYQKYMIFNELTKVSYKDERGVKQYFSGDEKQQIFKQLFQKERGKITVKKLQNFLYTHYHIENAQIFGIEKAFNASYSTYHDFMKLAKTNQKAMQEWLEQPEMEPIFEDIVKILTIFEDRQMIKHQLSKYQEVFGEKLLKEFARKHYTGWGRFSAKLIHGIRDRKTNKTILDYLINDDDVPANRNRNLMQLINDEHLSFKEEIAKATVFSKHKSLVDVIQDLPGSPAIKKGIWQSLKIVEELIAIIGYKPKNIVIEMARENQKTHRTSPRLKALENGLKQIGSTLLKEQPTDNKALQKERLYLYYLQNGRDMYTGEPLEIENLHQYEVDHIIPRSFIVDNSIDNKVLVASKQNQKKRDDVPKKQIVNEQRIFWNQLKEAKLISPKKYAYLTKIELTPEDKARFIQRQLVETRQITKHVANILHQSFNQEEEGTDCDGVQIITLKATLTSQFRQTFGLYKVREINPHHHAHDAYLNGFIANVLLKRYPKLAPEFVYGKYVKYSLARENKATAKKEFYSNILKFLESDEPFCDENGEIYWEKSHHLPRIKKVLSSHQVNVVKKVEQQKGGFYKETVNSKEKPDKLIERKNNWDVTKYGGFGSPVIAYAIAFVYAKGKTQKKTRAIEGITIMEQAAFEKDPTTFLKEKGFPQVTEFIKLPKYTLFEFDNGRRRFLASHKESQKGNPFILSDQLVTLLYHAQHYDKITYQESFDYVNTHLSDFSAILTEVLAFAEKYTLADKNIERIQELYEENKYGETSMIAQSFLQLLQFNAIGAPADFKFFGVTIPRKRYTSLTEIWDATIIYQSVTGLYETRIRMGDLWAGEQ

SEQ ID NO: 424 - protein, 116 aa, Enterococcus sp.
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTELLSKGEIYKVTLHILKNVELVT

SEQ ID NO: 425 - protein, 1391 aa, Eubacterium sp.
MENKQYYIGLDVGTNSVGWAVTDTSYNLLRAKGKDMWGARLFDEAKTAVERRTKRTSRRRSEREKARKAMLKELFADEINKVDPNFFIRLEESKFFLDDRSENNRQRYTLFNDAKFTDKDYYEKYKTIFHLRSALINSDEKFDVRLVFLAILNLFSHRGHFLNASLKGDGEIQGVDIFYNDLYEVCEEFEIDLPQISNIDNFEKILSQKGKSRTKILEELSEELSISKKEKIKYSLLKLICGMKIKVVDIYADEDIQEDDKKKDLGFRESDYEKSSLEVKEIIGDDHFELIERAKAVHDIGLLANIIGNSKYLCEARVEAYDNHHKDLQKIKELLKKYDIKAYTDMFRKMTDKNYSAYVGSVNSNIAKERRSVDNRKIEDLYEYIKKIALKNISDDNEDKIEILKKIETGEFLKKQLTASNGVIPNQLQSRELRAILKKAENYLPFLKEKGEKNLTVSEMIIQLFEFQIPYYVGPLDKNPKKDKNANSWAVIPSGGRILPWNFEDKVDVKGSRKEFIEKMVRKCTYLSEEHTLPKQSLLYEKFMVLNEINNIKIDGEKISVEAKQKIYNDLFMKGKKVSQKAIKQELISLNIMSKDSVLSGIDTVCNAYLSSIAKFRGVFDENVNNQSTIDMIEDIIFLKTVYSDEKRFVKEEIVEKYGDEIDKDKIKRILGFKFSNWGNISKSFLELEGADVGTGEIRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYSAIKEDSKQWVKELDAKDESYFRSKKMYLYYLQKGRCMYSGEVIELDKLMDDNLYDIDHIYPRSFVKDDSLDNLVLVKKEINNRKQNDPITPQIQASCQGFWKVLHEQGFISNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPAYKYHMDRFFERDVKSKSEVAWIGQSEGNAGTIAIVKKTMSKNSPLITKKVEEGHGSITKETIVGVKEIKFGRNKVEKADKTPKKANLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 426 - protein, 1391 aa, Eubacterium yurii
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 427 - protein, 1142 aa, Facklamia hominis
MYSVGLDIGIASCGYSIINDVNGNIVELGTLLFKSRNSDNNEERRTNRGSRRLINRRRTRLDDGKKLLAEKGFKQDSKLKHVCPYELRVKGLHEKLTQGEIYKVVLHILKKRGISYLDESDENSSGIDGASYKDQVNLNLNLQKELTPGQIQLKRLKENGRIKSGVTFENGYQLNVFSVSAYANELNKILTKQSEYYSEIDQIWIDRFTKNGYRKEAGLVYRKRPYYDGPGNEKNNSIYGRWANFKEDGHPKENIFDQLIGLDSVDSTQVRASASTLTAQKYNLLNDLNNLTIIEDDRKFTTDEKVSIINYLMTQDITRFGPKELAKFYQLEVDQIRGWRIDNKGNPEIHSLKVYRDWKKIFNTSSIDLTSIQTWVVDELANVITLNTEIPSTLATLKIKIPDIDQQILNFVENNFYELKKKTSKNSWHSFSLKTLNILIPELLNTSEEQNTILERLNLKFDLKNKYAEKNQIPVKELLEQIYNPTVTKSVHQSIKLFNEIIEKYGKNNISYVTIEMPRDKNDQDQKDTIKRINKLNSERKNDSEKYFLERSGWDTIRFESALKKPRFAEKLLFYYEQKGKCAYSGQDILAESLLNESCEVDHIIPLSISFDDSIHNKVLVTASSNQEKGQRTPYMAFIDGAKLGQSWDDFVAWVNSCGFHRKKVQNLLYEENIFNPDVQRGFVSRNLNDTRYASRIVLNAIQSFFYKQKDLTKVKVVNGSFTHTLRKKWGSSLDKNRDTYHHHAVDATLCAVTPFINIVKYEFFEEDGIKYMVDLTTGEKVAYSDYKKMKFYDKRAYVPIWDGFIKQLTPANLYPKIKFSHQVDSKWNRKISDATIYSTRKIVETKINKKGVAKETVKDIVIDKIKDIYTPEGWRKFKEKQDKLLMKNFDEKTYNKLIKIAKEYPEKKEVQTSNGKVSLVEVSPFKMYCEEQNVPAIRKYSKKGNGPYIRSLKFYDKELGKHINITKDSYGNDIERTIRNKKIILKNQNSWRTDVYYNSVNNCYELLGIKYCHLKFYRGKYGIPKSIYDELKKEDEISSESVFKFSLYRHDRVRFEKDGEYIEALFGSKNESNKNYLELSPIDKNKWLSKENVKFFGEVAASGRFIKGLKPGIKVIKQSTDYMGHVYAIHQEKLKFVLSDA

SEQ ID NO: 428 - protein, 1347 aa, Finegoldia magna
MKSEKKYYIGLDVGTNSVGWAVTDEFYNILRAKGKDLWGVRLFEKAKTAADTRTFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFVILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEAVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRIKGKPLDTDVKLKLIEELFKKKTKVTLKSIRDYMIRNNFADKEDFDNSEKNLEIVSNMKSYIDFNNILGDKFELEMVEDLIEKITIHTGNKTLLKKYIEETYPDLSSSQIQKIINLKYKDWGRLSRKLLDGIKGRNKTDDVNTVINFMRNSSDNLMQIIEGKNYSFNEYIDNLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDESELRSKKLYLYYTQMGRDMYTGEKIDLDKLFDSTHYDKDHIIPQSMKKDDSIINNLVLVNKNANQTTKGNIYPVPSSIRNNPDIYNYWKYLMEKEFISKEKYNRLIRNTPLTNEELGVFINRQLVETRQSTKAIKELFEKFYQKSKIIPVKASLASDLRKDMNTLKSREVNDLHHAHDAFLNIVAGDVWNREFTSNPINYVNENREGDKVKYSLSKYFTRPRKSKGKVIWTPEKGRKLIVDTLNKPSVLISNESHVKKGELFNATISGKKDYKKGKIYLPLKKDDRLKDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 429 - protein, 1348 aa, Finegoldia magna; identical to SEQ ID NO: 227

SEQ ID NO: 430 - protein, 1516 aa, Flavobacteriaceae bacterium
MLKQQKDKIIGMNKKILGLDLGTNSIGWALVKQDLENKYGEIIGCGSRIIPMSQDVLGKFDAGISISQTAERTNYRSVRKLIQRNTLRRERLHRVLHQLDFLPKHYNDSIDFEKKLGQFKTDKETKLNYFVNQHGKHEFLFKDSFNEMVKEFKEEQPELFYIKNNGKETKIPYDWTIYYLRKKALSKKISKEELSWLVLNFNQKRGYYQLRGEIDEEKEKNKRYEKLYVSEVVKTNNTIKKTGEYLYDIYFDNGWKYEKQTTKPQDWLHKHKEFIITTTTLKNGETKRTFKTVDSEKDWIAIKSKTEQDIKESNKTVGAFIYDTLLKNPTQKIRGSLVKTIERKFYREEFEKILKEQIKHRPEINVNTAIGKENYTKCVTELYPRNEAHANNILTNDFNYLFTKDILFYQRPLKSKKSEIANCQYEYRTYIKKKEKTGKEERVKQPLKATPKSHPLFQEFRLWQFIHNLKIYIRETTVGNKPLFDVDITDTFFTSENDWATLFEYLNNKKEIEQKHVLEYLVSKKIISKSEKTDYRWNYVEDKKYPGNETRVDFINRLKKVENLNVDEFLTSELEFKLWHIIYSVTDKNEYEKALENFAIRQNIDKDSFVNSFKKFPPFKSDYGAYSTKAIKKLLPLMRLGKFWDGSEIPKVVVEKITDIKTRLTSVNYDESLFKKDEKKILETIVDDITPKQLLKSFVKLKGKNHLAGLNTYQACYLVYERHSESSDITQWENPDDIDSFLNHFKQHSLRNPIVEQVVTETLRTVRDIWKYYGNGSPNYFNEIHIELGREMKNPADKRKQMSAKINENENTNQRIKGILQELMNDGVQDIKPYSPSQQEILKIYEEGISQNPNVDYSKVSEDEITKIKKSNNPTLKEIQRYKLWLEQKYISPYTGKPIPLSELFTPAYQIEHIIPQSRYFDNSLSNKIICESEVNEDKSNKTAYEYLKTNGGSIVHGHHLLSLKEYEDHCQHYFKKNRTKLKNLLSEEIPEGFINRQLNDSRYISKLIKGLLSNIVREENEQEATSKNIVPVTGSITSKLKQDWGLNDKWNEIIAPRFKRLNKMTNSNDFGYFDEKINTFRIQVPDAISRGFNKKRIDHRHHTLDALVIACCTKKHIQYLNSLNNEIIKHELKPSILIKNAQGDYTKHFMLPWNNFPIDCKNAIENTIVSFKQNLRVINKTSNKYQSYKDENGNLRLGKDGKPKKGLTKQTKGNNWAVRKAMHEDTFYGEIVDGENKGKLKIKTLLDTSFDVKKIEDKVLDKSIRTILINYLKQDKYKNLSKPHEEAFSPNGIIEMNKNIISLNNNIPHKPIKRVTLKHEKGKKFSIKTLLDKKTKFAKSATGTNVFFCIYKNINGKIKYHTPSFEEIIEIQKQEFEIKYKSKLNVPETLFDKKESFELLFYLQPNDLVYLPNDEELKNRQLIDFNNLNKKQIKRIYKFTDGSGTTANFIPYQVAKVIFNLNKKEQAKSSFKYPIQNEFGVGSPQSKNQKSIEGILIKERCIKLKIDRLGNISKA

SEQ ID NO: 431 - protein, 1629 aa, Francisella cf.
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINIQILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYRSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAITTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLANNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNITIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 432 - protein, 1646 aa, Francisella cf.
MNIKILPIAIDLGAKNTGVFSAFYQKGTSLESLDNKNGKVYELSKDSYTLLMNNRTARRHQRRGIDRKQLVKRLFKLIWTKQLNLEWNKDTQQTISFLLNRRGFSFITDGYSPEYLNIAPEAVKAILMSILDDYNGEDDLDSYLQSATENDSKIDELYNKLLQKALEFKLRKLCIDIKEDKVTTKTLKELSNTEFKLLANYLVDYDRILRTQKFSYTDKQGNLRELNYYHHDKYNIQEFLKRNIIINDVILEKLTDDLDIWNLNFDKFDFEKNLEKLENQEDKDYLQTHLHHFVFAVNKIKSEMASGGRHRSQYFQEITNVLVENNHQEGYLKNFCENLHNKKYSNLSVKNLVNLIGNLSNLELKPLRKYFNDKIHAKADYWDEQKFAETYSDWILGEWRVGAKDKDKKDGAKYSYKNLCDELKQKVGINQDGIINQTKSDFVDFLLELDPCRTIPPYLDNNNRKPPKCQSLILNPKFLDNKYPNWQQYLQELKKLQTVQNYLGNFEIDLKDLKSSKEQPYFVKYKSLNQQIASGQRDYKDLDARVLQFIFDRVKASDELLLNEIYSHAKKLKQNTSSELEKLELCKKLDEVIANSQLSQILKSQHVNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNQASKLEFDRKIKKFNSIYSFAQIQQIAFAERKGNANTCAVCSADNAHRMQQIKVAKPVEGNKDNIILSAKAQRLPAIPTRIVDGAVKKIATILARNIVDDNWDNIKQALSNNQQLHVPIITESNAFEFEPALADIKGKSLKDKRKKALERIDPENVFKDKNNRIKEFAKGISAYSDANLANGDFDGAKEELDHIIPRSHKKYGTLNDEANLICVTREDNQNRGNKAVFLYDLKPNYKLKQFNTTDDLEIEKKIADTIWDASKQDFKFGNYRSFINLTPQEQIAFRHALFLADKNPIKKAVIRAIDNRNRTFVNGTQRYFAEVLANNIYLRAKKENLATNRITFDYFGIETTNSNGRGIADVRKLYEKVDSDIQAYAKGDKPQDSYSHLIDAMIAFCVAADEHKNEGSIGLKMGNQYGLFPTPDKYDENTGEIISWHNDDIFRKIKVSDNQFSDKKLVRKKATEGFNTHRQMTRDGIYGESYLPILIHKNLNEVRKGYNWENSEEIKIFKGKKYDIQQLNNLVYCLKFVDKPISIDIQITTLEELRNILETNNISTTAEYYYINLKTQKLHEYYIENYNTALGYKKYTKEMEFLRSLAYRTERVKIKSIDDVSMILAKDSNFKAGKIELPFKTEWQRLYLEWQNTTIKDNHEFLKSYFSVKNATKQHKKVRKDFSLPISTNEGKLLVKRKTWDNNFIYQILNDSDSRADGTKPFIPAFDISKNEIVETIIKSFTSKNIFWLPKNIELQKVDNKSIFAIDTSRWFEVETPKDLIEIGVSTIQYKIDNNSRPKVRVKLDYVMDDDSKINYFMNHSLLKSRYPDKVLEILKQSTIIEFESSGFNKTIKEMLGMTLAGIYNETSNN

SEQ ID NO: 433 - protein, 1629 aa, Francisella novicida
MNFKILPIAIDLGVKNTGVFSAFYQKGTSLERLDNKNGKVYELSKDSYTLLMNNRTARRHQRRGIDRKQLVKKLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGLKDQDKKEGAKYSYKDLCNELKQKVTNAGLIDFLLELDPCRTIPPYLDNNNRKPPKCQSLILNPKFLDNQYPNWQQYLQELKKLQIIQDYLESFETDLKVLKSSKDQPYFVEYKSSNQQIASGQRDYKDLDARILQFIFDRVKASDELLLNEIYFQAKKLKQKASSELEKLESSKKLDEVIANSQLSKILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQVYAKGDKPQASYSHLIDAMLAFCIAADEHRNDGSIGLEIDKNYSLYPLDKNTGEVFTKDIFSQIKITDNEFSDKKLVRKKATEGFNTHRQMTRDGIYAENYLPILIHKELDEVRKGYTWKNSEEIKIFKGKKYDIQQLNNLLYCLKFVDKPISIDIQISTLEELRNILTTNNIAATAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 434 - protein, 1629 aa, Francisella novicida
MNFKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLMKLCTDIKDDKVSTKTLKEITSYEFELLADYLANYSESLKTQKFSYTDKQGNLKELSYYHHDKYNIQEFLKRHATINDRILDTLLTDDLDIWNFNFEKFDFDKNEEKLQNQEDKDHIQAHLHHFVFAVNKIKSEMASGGRHRSQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLDSFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLHKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSHKKYGTLNDEANLICVTRGDNKNKGNRIFCLRDLADNYKLKQFETTDDLEIEKKIADTIWDANKKDFKFGNYRSFINLTPQEQKAFRHALFLADENPIKQAVIRAINNRNRTFVNGTQRYFAEVLANNIYLRAKKENLNTDKISFDYFGIPTIGNGRGIAEIRQLYEKVDSDIQAYAKGDKPQASYSHLIDAMLAFCIAADEHRNDGSIGLEIDKNYSLYPLDKNTGEVFTKDIFSQIKITDNEFSDKKLVRKKAIEGFNTHRQMTRDGIYAENYLPILIHKELNEVRKGYTWKNSEEIKIFKGKKYDIQQLNNLVYCLKFVDKPISIDIQISTLEELRNILTTNNIAATAEYYYINLKTQKLHEYYIENYNTALGYKKYSKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTTIEFESSGFNKTIKEMLGMTLAGIYNETSNN

SEQ ID NO: 435 - protein, 244 aa, Francisella tularensis
ARKQNSEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQNQEDKDHTQAYLHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 436 - protein, 501 aa, Francisella tularensis
MEIEKKIADTIWDASKQDFKFGNYRSFINLTPQEQKAFRYALFLADENSIKQAVIRAINNRNRTFVNGTQRYFAEVLANNIYLRAKKENLNTDKISFDYFGIPTIGNGRGIADIRQLYEKVDSDIQAYAKGDKPQASYSHLIDAMIAFCVAADEHRNDGSIGLEIDKNYSLYLLDKNTGEVFTKDIFSQIKITDNEFSDKKLVRKKATEGFNTHRQMTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQNVDKIFLL

SEQ ID NO: 437 - protein, 158 aa, Francisella tularensis
MIDFLLELDPCITIPPYLDNNNRKPPKCQSLILNPKFLDNQYPNWQQYLQELKKLQSIQDYLDSFETDLKDLKSSKDQPYFVEYKSSNQQMASGQRDYKDLDARILQFIFDRVKASDELLLNEIYFQAKKLKQKASSELEKLESSKKLDEVIANSQLS

SEQ ID NO: 438 - protein, 878 aa, Francisella tularensis
MLNDLAGVLQVSRNQLLSSVEEWFQQAQRVGEISKSQDEQIFEWLKSFKIASYCKAAVEMQKQYRGTLKNAIQTAIFRQSENINKNKNKNKNTGNQQQALSENSKDVKSLTADEKKLLKLIENIAKASQKIGESLGLNDKQIKKFNSIYNFAQIQQIAFAERKGNANTCAVYSADNAHRMQQIKITELVEDNKDNIILSAKAQRLPAIPTRIVDGAVKKMATILAKNIVDDNWQNIKQVLSAKHQLHIPIITESNAFEFEPALADVKGKSLKDRRKKALERISPENIFKDKNNRIKEFAKGISAYSGANLTDGDFDGAKEELDHIIPRSYKKYGTLNDEVNLICVTRDDNKNKGKRIFCLNDLANNYKLKQFETTDDLEIEKKIADTIWDASKQDFKFGNYRSFINLIPQEQKAFRYALFLADENSIKQAVIRAINNRNRTFVNGTQRYFAEVLANNIYLRAKKENLNTDKISFDYFGIPTIGNGRGIADIRQLYEKVDSDIQAYAKGDKPQASYSHLIDAMIAFCVAADEHRNDGSIGLEIDKNYSLYPLDKNTGEVFTKDIFSQIKITDNEFSDKKLVRKKATEGFNTHRQMTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSINKLHKKVRKDFSLPISTNEGKFLVKRKTWDNNFIYQILNDSDSRVDGTKPFIPAFDISKNEIVEAIIDSFTSKNIFWLPKNIELQKVDKIFLL

SEQ ID NO: 439 - protein, 292 aa, Francisella tularensis
MLNDLAGVLQVSRNQLLSSVEEWFQQAQRVGEISKSQDEQIFEWLKSFKIASYCKAAVEMQKQYRGTLKNAIQTAIFRQSENINKNKNKNTGNQQQALSENSKDVKSLTADEKKLLKLIENIAKASQKIGESLGLNDKQIKKFNSIYNFAQIQQIAFAERKGNANTCAVYSADNAHRMQQIKITELVEDNKDNIILSAKAQRLPAIPTRIVDGAVKKMVTILAKNIVDDNWQNIKQVLSAKHQLHIPIITESNAFEFEPALADVKGKSLKDRRKKALERISPENIFKDKNIC

SEQ ID NO: 440 - protein, 53 aa, Francisella tularensis
MNHSLLKSRYPDKVLEILKQSTIIEFESSGFNKTIKEMLGMTLAGIYNETSNN

SEQ ID NO: 441 - protein, 393 aa, Francisella tularensis
MNVKILPIAIDLDVKNTGVFSAFYQKGTSLEKLDNKNGKVYELSKDSYTLLMNNRTAQRHQRRGIDRKQLVKRLFKLVWTEQLNLEWDKDTQQAISFLFNRRGFSFITDGYSTEYLNIVPEQVKAILMDIFDDYNGEDDLDSYLKLATEQESKISEIYNKLMQKILEFKLRKLCTDIKDDKVSTKTLKEITSYEFELLADYLANYSESLKTQKFSYTDKQGNLKELSYYHHDKYNIQEFLKRHATINDEILDTLLTDDFDIWNFNFEKFDFDKNEEKLQNQEDKDHTQAYLHHFVFAVNKIKSEMASGGRHRSQYFQEITNVLDENNHQEGYLKNFCENLHNKKYSNLSVKNLVNLVGNLSNLELKPLRKYFNDKNLIIGMSKSLQKLIATGY

SEQ ID NO: 442 - protein, 1629 aa, Francisella tularensis
MNVKILPIAIDLGVKNTGVFSAFYQKGTSLERLDNKNGKVYELSKDSYTLLMNNRTARRHQRRGIDRKQLVKRLFKLIWTEQLNLEWDKDTQQAISFLFNRRGFSFITDGYSPEYLNIVPEQVKAILMDIFDDYNGEDDLDSYLKLATEQESKISEIYNKLMQKILEFKLRKLCTDIKDDKVSTKTLKEITSYEFELLADYLANYSEILKTQKFSYTDKQGNLKELSYYHHDKYNIQEFLKRHATINDEILDTLLTDDLDIWNFNFEKFDFDKNEEKLQNQEDKDHTQAHLHHFVFAVNKIKSEMASGGRHRGQYFQEITNVLDENNHQEGYLKNFCENLHNKKYSNLSVKNLVNLIGNLSNLELKPLRKYFNDKIHAKADHWDEQKFTETYCHWILGEWRVGVKDQDKKDGAKYSYKDLCNELKQKVTKAGLVDFLLELDPCRTIPPYLDNNNRKPPKCQSLILNPKFLDNQYPNWQQYLQELKKLQSIQNYLESFETDLKVLKSSKDQPYFVEYKSSNQQIASGQRDYKDLDARILQFIFDRVKASDELLLNEIYFQAKKLKQKASSELEKLESSKKLDEVIANSQLSQILKSQHTNGIFEQGTFLHLVCKYYKQRQRARDSRLYIMPEYRYDKKLDKYNNTGRFDDDNQLLTYCNHKPRQKRYQLLNDLAGVLQVSPNFLKDKIGSDDDLFISKWLVEHIRGFKKACEDSLKIQKDNRGLLNHKINIARNTKGKCEKEIFNLICKIEGSEDKKGNYKHGLAYELGVLLFGEPNEASKPEFDRKIKKFNSIYSFAQIQQIAFAERKGNANTCAVCSADNAHRMQQIKITEPVEDNKDKIILSAKAQRLPAIPTRIVDGAVKKMATILAKNIVDDNWQNIKQVLSAKHQLHIPIITESNAFEFEPALADVKGKSIKDRRKKALERISPENIFKDKNNRIKEFAKGISAYSGDNLASGDFDGAKEELDHIIPRSHKKYGTLNDEANLICVTRDDNKNKGNRIFCLHDLANNYKLKQFETTDDLEIEKKIADTIWDASKKDFKFGNYRSFINLTPQEQKAFRHALFLADENPIKQAVIRAINNRNRTFVNGTQRYFAEVLANNIYLRAKKENLNTDKISFDYFGIPTIGNGRGIVEIRQLYEKVDSDIQAYAKGDKPQASYSHLIDAMLAFCIAADEHRNDGSIGLEIDKNYSLYPLDKNTGEVFTKDIFSQIKITNNEFSDKKLVRKKATEGFNTHRQMTRDGIYAENYLPILIHKELDEVRKGYTWGNSEELKIHKGKKYDIQQLNNLVYCLKFIDKSISIDIQISTLEELRNILTTNNIATTAEYYYINLKTQKLHEYYIENYNTALGYKKYTKEMEFLRSLAYRSERVKIKSIDDVKQVLDKDSNFIIGKITLPFKKEWQRLYREWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDNKNIFAIDTSKWFEVETPSDLRDIGVATIQYKIDNNSRPKVRVKLDYVIDDDSKINYFTNHSLLKSRYPDKVLEILKQSTIIEFESSGFNKTIKEMLGMTLAGIYNETSNN

SEQ ID NO: 443 - protein, 285 aa, Francisella tularensis
MTRDGIYAENYLPILIHKELDEVRKGYTWGNSEELKIHKGKKYNIQQLNNIVYCLKFIDKSISIDIQISTLEELRNILTTNNIAATAEYYYINLKNQKLHEYYIENYNTALDYKKYSKEMEFLRSLAYRSERVKIKSIDDVKQVLDKDSNFIIGKITLPFKKEWQRLYLEWQNTTIKDDYEFLKSFFNVKSITKLHKKVRKDFSLPISTNEGKFLVKRKTWDNNFIYQILNDSDSRVDGTKPFIPAFDISKNEIVEAIIDSFTSKNIFWLPKNIELQKVDKIFLL

SEQ ID NO: 444 - protein, 1323 aa, Fructobacillus fructosus
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 445 - protein, 1367 aa, Fusobacterium sp.
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 446 - protein, 1367 aa, Fusobacterium sp.
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIKKLEKIICDSGKGLKDKEKEFKEIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKGKKEVVEKSGLKIDDLIKVIKGYLPKPERIEEKDKIIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNGNKEMNEVSYRDLIEESYVSPSLKRAILQTLKIYEEIKKITGRVPKKVFIEMARGGDETMKNKKIPARQEQLKKLYDSCGNDIANFSIDIKKMKSSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMKKNTVNITRFIKEEKGQLFDLNPIKKGETSNEIISIKPKLYNGKEEKLNEKYGYYKSLNPAYFLYVEHKEKNKRIKSFERVNLVDVNNIKDEKSLVKYLIENKKLVEPRLIKKVYKRQVILINDYPYSIVALDSNKLMDFENLKPLFLENKYEKILKNVIKFLEDNQGKSEENYKFIYLKKKDRYEKNETLESVKDRYNLEFNEMYDKFLEKLDSKDYKNYINNKKYKNLLDVKEKFIKLNLFDKAFTLKSFLDLFNRKTMADFSKVGLTKYLGKIQKISSNVLSKNELYLLEESVTGLFVKKIKL

SEQ ID NO: 447 - protein, 1367 aa, Fusobacterium sp.
MKKQQFSDYYLGFDIGTNSVGWCVTDFNYNVLRFNKKDMWGSRLFDEAKTAAERRVQRNSRRRLKRRKWRLNLLEEIFSDEILKIDSNFFRRLKESSLWLEDKSSKEKFTLFNDDNYKDYDFYKQYPTIFHLRNELIKNPEKKDIRLVYLALHSIFKSRGHFLFEGQNLKDIKNFETLYNNLMAFLEDNDIYKNIDSSYIGNLENIICDSKKGLKDKEKEFKEIFNSDKQLVGFFKLSVGSSVSLNDLFDTDEYKKGEVEKEKISFREQIYEDDKPIYYSILGEKIEFLDIAKSFYDFMVLNNILADSQYISEAKVKLYDEHKRDLKNLKYIIRKYNKENYDKLFKDKNESNYSAYIGLNKEKGKKEVIEKSRLKIDDFAKIIKGYLPKAEKIDEKDRSIFNEILDKIELKTILPKQRISDNGTLPYQIHEAELEKILENQAKYYDFLNHEENGISTKDKLLMTFKFRIPYYVGPLNSYHKNKGGNSWIVRKEEGKILPWNFEQKVDIEKSAEEFIKRMTNKCTYLNGEDVIPKDSFLYSEYIILNELNKVQVNDEFLNKEIKKKIIEDLFKKSKKISEKNFREYLLVNQITNKTVELKGVKDAFNSNYVSYIKFKDIFGDKLNLDIYKEISEKSILWKCLYGDDKKIFEKKIKSVYGDILTKDEIKKINSFKFNTWGRLSEKLLTEIEFIDLETGECYSSVMDALRRTNYNLMELLSSKFTLQENIDNENKEVSEFSYRDLVEESYVSPSLKRAILQTLKIYEEIRKITGRIPKKVFIEMARGGDETMKNKKIPARQEQLKKLYDSCGKDISNFSIDIKEMKNSLNSYDNNSLRQKKLYLYYLQFGKCMYTGKEIDLNRLLQNNDTYDIDHIYPRSKVIKDDSFDNLVLVLKNENAEKSNEYPLKKEIQEKMKSFWKFLKEKNFISDEKYKRLTGKDEFELRGFMARQLVNVRQTTKEAGKILQQIEPEIKIVYSKAEIASSFREMFDFIKVRELNDTHHAKDAYLNIVAGNVYNTKFTEKPYRYLQEIKENYDVKKIYNYDIKNAWDKEKSLEIVKKNMEKNTVNITRFIKEEKGQLFDLNPIRKGETSNEIIAIKPKFYEGSTEKLNEKYGYYKSLNPAYFIYVEHKEKNKIIRSFERVNLVDVNKIKDEKSLIKYLIENKGLIEPKVIKKVYKRQVILINNFPYSIVALDSNKLMDFENLKPLFLERKYEKILKNAIKFLEDNQGKTEEYYKFLYLKKKDRNEKNETIDSVKERYNIEFNEMYDKFLEKLDSKDYKNYINNKKYSELVNVKEKFIKLNLFDKAFTLKSFLDLFNRKTMADFSKVGLTKYLGKIQKISSNVLSKNELHLLEESVTGLFVKKIKL

SEQ ID NO: 448 - protein, 1391 aa, Galbibacter sp.
MKTILGLDLGTNSIGWALVKEAENENEVSDIIKLGVRVNPLTVDELTNFEGGKAYSNNAERTLKRGARRNLQRYKLRRENLIEILLKNGLINKDTALTEVGKETTHQTLKLRSKSANEKVSLEDLAKILLSINKKRGYKSSRKVNAEDDGVAIDGMEVAKLLYDENMTPGEYVLRLLESGKKHLPDFYRSDLQEEFNLVWKKQSEFYPLILTKELFFELHGKNKSQTWAICKEPLGIVGVKLKGSAKEQKFARYRLRKEALTQQIELEHLAIVLQDINNDSNKSSGYLGAISDRSKELFFNKETVGQYQYKQLQKDPNTSLKNQVFYRQDYLDEFEVIWRNQAKFYPQLTNELKQEIRDVVIFYQRKLKSQKNLISFCQFESTQQNYVEKETGKTKIRTIGRRVIPRSSPLFQEFKIWQSLNNLKFVNSESNQIIQFIELEDDVKKVVFDELNLRGDLKPNQVLKILSKYMKIGKLTQWKCNLEEIEGNRTNSALYNVFQMIAEEEGYGFNWGKKSALEIKSELKAIFSSIGINDSILDFDFSKKLDQQLSYQLWHLLYSAEEGNSKITEEDKFTYGNTGVALKKKLHLKFGFKPEYSTLISNLRFTSDYGNLSSKAISKILPFLRDGSDYSKACQYAGYNHSNSLSADELDNRELKPKLELLKKNSLRNPVVEKILNQMVNVVNQVIDNYGKPDEVRIELARELKKSAKERSQMTKNISDATRRNAEIKKYLSKEFGIPNPTKGDVIRYRLWEELASNGYKDLFRDKYIPKEKLFSNEIDIEHIIPKALLFDDSFSNKTLAFKVDNLKKADRTAFDFMSTDFSKDVDSYIGRIETLHKDGKISSSKYKKLMIPKSKLVDGFIERDLRNTQYIAKQARKMLLEVFKTVVPTTGKITDKLREDWDLINVMKELNFPKYKALGLTKKIERFDVGSEKIKSINVIEGWSKRNDHRHHAMDALAVAFTTHNHIQYLNYLNARKDIHHEMHGTIKSIENQIIGKDVMGKRRFIPPISDLRMKAKLQIESILISFKNKNKVVTWSVNKTKLKGKDNYNKRRQLTPRGQLHKETVYGKIKLIDPKPLKLNNKFTLVRASMIVDKVHREIVLQHLSKYDNNSEVAFDSKTIKIDPILIEGIGLKEVVCYEDVFKIRKKISGDNFKNEKHLEKVIDEKVKQILKDRVIKFQGNFKEAFSNLEENPIWLNKSKGIAVKSVAIKGVNNAESLHEGKDHFGDQILDKNKKQIPVDFVSTGNNHHVGIYEDKDGNLQERVVSFFEAVTRVNEGLPIIDKTYNSDIGWKFKFTMKQNEMFVFPSDDFDPNEFDLTDGKNAAKISPNLYRVQKIATKNYMFRHHLETVVTNDLEFTYKSIRSTGWLRNLVKVRINHLGEIVYVGEY

SEQ ID NO: 449 - protein, 1186 aa, Gardnerella vaginalis
MEGNISYAIGIDVGLNSVGLAAIRLDDYGEPIRILKAMSVIHDAGIDPNGAKESDTRKAISGVARRVRRLYRQRRRRLQKLDFLLQSLGWPVVENKDLDFSDSFIPWIFRAKLADEYIADEEQRKQMLSVAIRHIARHRGWRNPYQSIKSMMQETEYSEFYNELLKNIEKLAPGVGCEGSTPAQLVRDYLLSQQGKASRRLRITTGGRRKNHPHSLDPVLPRKLMQSDNMLEILNIFNVQHIDDKYVREQIINAVFYAESPRGSAENRVGKDAITGKGKRALKASLAFQKYRIISTISNLRIRENSKERCLTIEEKQNVYKLLTTSIDKSSKRKSAEAPLYTWIDVADCLGIERYKLRGVGSQIGDGESVGNRPPMLNSELAILYANNKSLGQSLITWWLASNRTQEDKEALIEILSNTVDIEAIHDNPEYQDKYGSAIAFIDSMNETEIAALENISLPDGRAAYSLETLDELNKQMLETDDDLFEARKKLFNLPNNWRPAEAPIAEPTGNPSVDRVLKIVHRFLISAKNRWGNPERINIEHVRSGFQSKKMANSYKELLDKRTEGKENLKAMMRNSLHLGTSDSISDADIRRYEAVQRQNGQCLYCGSEITYHTCELDHIVPRKGPGSTNTRENLVATCSSCNAQKCNTPFATWCEQSTYCKNHDISADSAINRVRAFIFPPNSYDKRGANQFKKEVIARLKQKVGDEAFDNRSIESVAWMANELHRRIDWYYNSQNYQTNNGISDISNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYSNSSVHQYEVNALLKLHVGDEIDSETIRRSSTPALYCALTRNPDYDVNNGFPENPGRTILLHNKKLNADDSITFFKAQAVQLFVREGSAKIGNSIHHLRIYEYFEKLKSGKIKKSYGMIRVFQNDLHRHIHEDLFSCDLPEQSISMRYADTKVAHAVQTGNANYLGYLVPGDEIIVDFSHITLSENIGKFVEFLNKIGADCTAYRHWVVVGTDTEKVLILKPSMISSEGIDKLYSNCERNNFDYSSYEKSINEILAGKGWRVSVNVLAQYKAATIRRNALGEVRWASRSHLPISWSWDTGENRE

SEQ ID NO: 450 - protein, 1186 aa, Gardnerella vaginalis
MEGNISYAIGIDVGLNSVGLAAIRLDNNGEPIRILKAMSVIHDAGIDPNGAKESDTRKAISGVARRVRRLYRQRRRRLQKLDFLLHSLGFPVVENKDLDFSDSFIPWIFRAKLADEYIADEKQRKQMLSVAIRHIARHRGWRNPYQSIKSMTQETEYSEFYNELLKNIEKFAPGVGCEGSTPAQLVRDYLLLQQGKASRRLRITTDEKRKNHPNSLNPILPRKLMQSDNMLEILNIFNVQHIDDKYVREQIINAVFYAKSPRGSAENRVGKDAITGKGKRALKASLAFQKYRIISTISNLRIRENSKERCLTIEEKQSVYKLLTTSTDESSKEKSAEAPLYTWIDVADCLGIERYKLRGVGSQIGDGESVGNRPPMLNSELAIIYANNKSLGKSLLTWWLDANRTQEDKEALIEILSNTVDIEAIHDNPEYQDKYGSAIAFIDSMDETEIAALENISLPDGRAAYSLETLDKLNKQMLETDDDLFEARKKLFNLPNNWRPSEAPIAEPTGNPSVDRVLKIVHRFLISAKNRWGNPERINIEHVRSGFKSKKMANSYKELLDKRTKGKENLKAMMRNSLHLGMSDSISDADIRRYEAVQRQNGQCLYCGSEITYHTCELDHIVPRKGPGSTNTRENLVATCSLCNAQKCNTPFSTWCEQSTYCKNHDISVDSAINRVRAFIFPPNSYDKRGANQFKKEVIARLKQKVGDEAFDNRSIESVAWMANELHRRIDWYYNSQNYQTNNGISDITNKAQTNVGVYAGSLTAIARRMSGIDGKLEFFDGRRKTRFDRRHHAVDASVIAMMTPGIAQILAIKCNLRETQLLQGNKVVPGGIDWKEYPTANDQGYQQYANWSVRMNALLKLLNEEMRADRIAVVNSIRLRYNNSSVHQYKVNALLKLHVGDEIDSGTIRRSSTPALYCALTRNPDYDVNNGLPENPNRAILLHDKKLNADDSITFFKAQAVQLFVREGSAEIGSSTHHLRIYEYFKKLKSGKIKKSYGMIRVFQNDLHRHIHEDLFSCDLPEQSISMRYADTEVAHAVQTGNSNYLGYLVPGDEIIVDFSHVKLSGNIGTFVEFLNKIGANCAAYNHWVVVGTDTEKVLILKPSMISSEGIDKLYSNCKRNNFDYSSYEKSINEILVGKGWRVSVNVLAKYNAETIRRNALGEVRWTSRSHLPISWSWNTGENRE

SEQ ID NO: 451 - protein, 1258 aa, Gemella haemolysans
MTEENPDIRKVFLAIHHILKNRGHFLLQGQSFKEGNLNNLIKELLNLDILHISIEITEENINKITEIALEKKTLTDKVNDLKKIYPKEKQLLEAFRLIFGGKTSLDKLFAIDEYKELDASVKSVSFKEKIYEEVRHDYEQVLSNYIELLDLAKLVYDSIILSDIKKEGKTLSESKVELYHKHREDLTKLKTLVKNDSKLSEDKKVELYSAIFKEDKDKGTNYVNYIRKSEEGKGCNYEDFKKFLVKELAKLEESSAKEEILRDLELELFLPLQRTKDNSVVPYQIHKEELVKILDNAAKYHKFLNEKDDSGYSIIEKVIQLLEFRIPYYVGPLNSSKKAKVDGFAWSVRNKGYENTPVTPWNYEKVIDESASAEKFITNLTNKCTYLKGEDVLPKSSLLYSEFALLNELNALKYDGNRISLEARNVIIEKLFKEQGKKVTKTSIKNLLKAEGYIDGKGEITGIDITVKNDLKSYRDFKKILGDKFNTEHVENIILWITLYGESRKLIKAKIEAVYGDIYSKEEIAKMSRLVYKDWGRFSRKLLTELVSKKLYNEETGECLNIIGAMRQNNILFMELLADRFDYSQQIIDYNKELQKEVTEITPEILDDLYVSPSVKRSIWQTVRIVEELKKIIGCAPAKIFVETTRSNQDKKKPTDSRKKQLELFYKAVKKDVKDLEKEIGSLNFDKLNERLSSVEPSKLKAKKLYLYYTQLGRCMYSGETIDITQLNTTAYDIDHIYPQSKVKDDSFTNTVLVKREYNAAKTDRYPLGSDIQTPSNRRFWKFLKEKGLITDEKYNRLVRTEEFSDEELTGFIARQLVETSQSVKAVAGILGELNPKTSICYSKAENVSSFRQNFGKIKEGNRKSDNTEQLIKVREINDYHHAKDAYLNVVVGNVYDTKFTRNVFNFIKDKKDGRKYSLNNVFYENVSNSNNVAWELNKTVHQVEKVMNNNNILVTRRTSEQKGGLFDATVYKAKVAAKAKEGVYYPLKTSDPVVNDVTKYGGFTKVKIAYYSIFEYTLVNKKGEEKITRIIPIPIYVSQNIKDDSTLLEFGKTQINIKSGEEVKDFKLKYRKLCIGDLVKINNFFNFIGGKTNDSFVYDGAVQVTLDTESERYIKTLSKYQNWKKENKDGELWESITKEKNTELYNLLVEKMNSGIFIKKKPNKFNELNSEEIRNNFSSISLEEQAKVLLEVLNLLTNKKSIFDLKSINITAARGKISFNLSNLSQFSIIEQSVAGFYEKEITIIGDKENDMENNNC

SEQ ID NO: 452 - protein, 1054 aa, Haemophilus parainfluenzae
MENKNLNYILGLDLGIASVGWAVVEIDEKENPLRLIDVGVRTFERAEVPKTGESLALSRRLARSARRLTQRRVARLKKAKRLLKSENILLSTDERLPHQVWQLRVEGLDHKLERQEWAAVLLHLIKHRGYLSQRKNESKSENKELGALLSGVDNNHKLLQQATYRSPAELAVKKFEVEEGHIRNQQGAYTHTFSRLDLLAEMELLFSRQQHFGNPFASEKLLENLTALLMWQKPALSGEAILKMLGKCTFEDEYKAAKNTYSAERFVWITKLNNLRIQENGLERALNDNERLALMEQPYDKNRLFYSQVRSILKLSDEAIFKGLRYSGEDKKAIETKAVLMEMKAYHQIRKVLEGNNLKAEWAELKANPTLLDEIGTAFSLYKTDEDISAYLAGKLSQPVLNALLENLSFDKFIQLSLKALYKLLPLMQQGLRYDEACREIYGDHYGKKTEENHHFLPQIPADEIRNPVVLRTLTQARKVINGVVRLYGSPARIHIETGREVGKSYKDRRELEKRQEENRKQRENAIKEFKEYFPHFAGEPKAKDILKMRLYKQQNAKCLYSGKPIELHRLLEKGYVEVDHALPFSRTWDDSFNNKVLVLANENQNKGNLTPFEWLDGKHNSERWRAFKALVETSAFPYAKKQRILSQKLDEKGFIERNLNDTRYVARFLCNFIADNMHLTGEGKRKVFASNGQITALLRSRWGLAKSREDNDRHHALDAVVVACSTVAMQQKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLKLKDLELMVNREREKDLYDTLKARLEAFNDDPAKAFAEPFIKKGGAIVKSVRVEQIQKSGVLVREGNGVADNASMVRVDVFTKGGKYFLVPIYTWQVAKGILPNKAATQYKDEEDWEVMDNSATFKFSLHPNDLVKLVTKKKTILGYFNGLNRATGNIDIKEHDLDKSKGKQGIFEGVGIKLALSFEKYQVDELGKNIRLCKPSKRQPVR

SEQ ID NO: 453 - protein, 1052 aa, Haemophilus parainfluenzae]
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMIGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 454 - protein, 121 aa, Haemophilus pittmaniae
MLNRRYAAKITRFVRFEAGDVFTGERIDRETGEIIPLHFPTPWQFFKQEVEIRIFSDNPKLELENRLPDRPQANHEFVQPLFVSRMPTRKMTGQGHMETVKSAKRLNEGISVIKMPLTKLN

SEQ ID NO: 455 - protein, 203 aa, Haemophilus pittmaniae
MVNREREKDLYDALKARLEAFNDDPAKAFAEPFIKKGGAIVKSVRVEQVQKSGVLVREGNGVADNASMVRVDVFTKDGKYFLVPIYTWQVAKGILPNKAATQYKDEEDWEVMDNSAIFKFSLHPNDLVKLVTKKKTILGYFNGLDRATGNIAIKEHDLEKSKAKGGIHQGVGIKLALSFEKYQIDELGKNIRLCNPSKCQSVR

SEQ ID NO: 456 - protein, 1052 aa, Haemophilus sputorum
MKNTSLNYVLGLDLGISSVGWAVVEIDEKENPLSLIDVGVRTFERAETQKGESLALARRLARSARRLTQRRVARLKKAKRLLKSENILLSTDECLPHQVWQLRVEGLERKLERQEWAAVLLHLIKHRGYLSQRKNESKSENKELGALLSGVANNHKLLQQTTYRTPAELAVKKFEVEEGHIRNQQGSYTHTFSRLDLLSEMELLFSRQQHFGNPFTSEKLLENLTALLMWQKPALSGDAILKMLGKCTFENEYKAAKHTYSAERFIWITKLNNLRIQENGLERALNDNERLALMKQPYEKAKLTYAQVRSILNLSDEAIFKGLRYSGEDKKTSETKTVLMEMKAYHQIRLALEKNDLKTEWAELKVNSSLLDEIGTAFSLYKTDEDISTCLAGKLSQPVLNALLENLNFDKFIQLSLKALHKILPLMQQGLRYDEACAEIYGDHYGKKTEENHLLLPQIPADEIRNPVVLRTLTQARKVINGVVRLYSSPARIHIETGREVGKSYQDRRELEKRQEENRKQREKAISEIKTLFPNFSGEPKAKDILKMRLYYQQNAKCLYSGKPLELHRLLEQGYVEIDHALPFSRTWDDSFNNKVLVLANENQNKGNLTPFEWLDGKNNSERWKAFKALVETSAFPYTKKQRILSQKLDEKGFIERNLNDTRYVARFLCNFIADNMHLTGEGKRKVFASNGQITALLRGRWGLAKSREDNDRHHALDAVVVACSTVSMQQKITRFVRFEEGNVFTGERIDRETGEIIPLHFPAPWKFFREEVEIRIFSDNPKLELENRLIARPQANHEFVQPLFVSRMPTRKMTGQGHMETIKSAKRLNEGLSVIKMLLTKLRLKDLESMVNREREKELYEALKARLEAFNDEPAKAFAEPFMKKGGAIVKSVRVEQVQKSGVLVRDGNGVADNASMVRVDVFTKGGKYFLVPIYTWQVAKGILPNKAVIQGKNEEDWEVMDDATFRFSLHQNDLVKLVTKKKTIFGYFNGLNRATGNIDIKEHDLEKSKVKDGIHQSIGIKLALSFEKYQVDELGKNIRLCKSSKRQAVR

SEQ ID NO: 457 - protein, 1338 aa, Helcococcus kunzii
MQDYYLGLDIGTNSVGWAVTDENYNLLRKKGKDLWGVRLFKEAQPATERRGHRSSRRRTIRKSLRKQLLRELFEEEINAIDKDFFLRLDESKYWLEDKKIEGKYSLFNDENFTDKDYYEKFPTIFHLRKALIESDDKEDIRLYFLAINQMMKRRGHFLIDGKLSNVEDITPFKECIQNLINEELDTEIETEFYDKAIKIVSDYSLKKTEKKNLIKDLVKETDSIEDSKKIINIFNLLISGKSKVNGIFDDEEILEKIKEDNKEDFYLTSEKYEENLEYFSQLLDYRFELISSLKSIYDYIILQEVLKGKKYLSYAQVERYKNHKEDLRKLKQLIKKYDKNGKIYYQIFRDENFKKGYVAYLGYYKKNKKNVPVKKCDYDTFSKNIKSTLDKICDKEDPLYIELIDKIEKGGFLLKQIVSTNSVIPHQVHELELDKILENLEKNYPSFKEISDGVSKIDKIKMIFNFRIPYYVGPLNDYHKDKVNSNTWIVKNEGFENENIRPWNFSKIVDEHACEEEFIKRMINECSYIPGEKVLPKSSLLYSEYMVLNELNNLRVNGDKLNPKIKKEIVENIYKKERKVTLKKIRNFLIINNYVDSKVEFSGLSDGIKANMSSYIDFAEILDDNFDNNMVEDLIEQITIHVGNVKLLTEKISNKYPNLEKKQINKIVNLKFKDWARFSRKLLVGIEGTEKETGEINTIIGFLRETNENFMELMSNRYTFSEEISEIKKKYIPNKLSKQIVDDLYVSPAVKKMIWQVLNINDELIKVLGKQPKKIFIEMARGKEEKPEVKDSRKNKLIELYKNLGKEGKEWLNRIEDKTEADFRNRALYLYYTQMGRCMYTGEIIDIERLYDKELYDLDHIIPRKMKKDDSIHKNLVLVTRNSNQYEKKDNYPVPEVIKSRENVRHLWYALKKKGLITEEKYNRLTRINPLSDKELSEFIERQLVETRQTTKVVKDLFENYYTDSKIVTVKAGLVSELRRDFEVLKCREINDLNHAHDAFLNIIVGDVWSKKFTSNPYNFVKKNREKYTLNNIFTKNQKDLRGNEIWNCAEGKKRIIKTLNKPSVLFSVENFEQTGQLFDQNIIGKQDYKEKTSYVPIKGDERLQDISKYGGYRGISGAYFFIVEHTEKNKRVKTIESLPIYMKSYVEENGLLDFCTNEMKLVDPKIIVKKLNYKSEIIVDGFKYLISGKTENRLSLETNEYLYWNHTQTTDIKKILNINEKIELEKYNGDIESERENIIKYIQIILEKFKLKPFIKRRNLPNIEINFADYETEKLLQLLVNLIPLTTKYVSPVDLTVISGSKYAGKVLIPKKISNLNEVIFISKSITGIYESRRRII

SEQ ID NO: 458 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFENKLLTKIFEQRPLKSFADKVGNCCFIAGEKRTPKDSLSAIEFIALSRTINTLINLSKESGEIYNRAIILQIVESTLKKGEISYKELREIIRLDERLRFKDPRLDYSREIKEAEKVKFLEFKQLKGFKKALGESFTTLARSQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNALLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLGKGQKGSKKHIAIVNGALTSTMRYYLGFASKDRDNHLHHALDAVIIGFMNDSVIKAFSDFKKTQETSKAAYYAHTLSKQEYKKQRAFIQLPSGENFRASVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDKNGVIKDWLEMDSSYEFIFSLYKDDLLLVQKKEMAEPELCYFMSFNSSIAQISVAKHDNNFSTLTKNQKLLFSNATQEDVSGKSIGIQNLQVFEKWQVSVLGEVKRTQSYPRENISLASKAKK

SEQ ID NO: 459 - protein, 1023 aa, Helicobacter cinaedi
MKIYSFDIGVASIGWAFIENEVLQDCGIRIFTKAENPKNGASLALPRREARGVRKRLARRRGRLNTIKQLLCKEFGLQLEDYLSNDGELPKAYTASKANPLKSPYELRTLALSQKLDSKDLVRVILHIAKHRGYGNKHAKDSKDTESGKVKKAIEFNRKTLAEKGYRSVGEYLYREFFQQSRISQNNGATEFINVRNKAGNYEHCVAQDMLKEELESILNAQRQFGFSLKQDFESKLLTKIFEQRPLKSFADKVGNCCFIAGEKRAPKDSPSAIEFIALSRTINTLINLSKESGEIYNRAIILQIVESTLKKGEISYKELREIIRLDERLRFKDPRLDYSREIKEAEKVKFLEFKQLKGFKKALGESFTTLAISQLDEIAEHIALIKDRVKLNEKLESYALTKEQREALSNLSFSAHINLSLQALKQILPFMRGDNGEQCLDYDESVEKAGLKALSKDTLKGQMLPPLNEFEPYLSNPVVARALAEYRKVLNVLLKQYGSPHKIHIEYAREAKLSSTERQKYEKEQKDNYAANQAAHKKCQELGLEPSSTNLLKLKLWQEQGGLCLYSGAKITISYLQDPTALQVDHIYPYSRSFDDSYMNKCLVLTKANQEKGNRTPFEAFGTDSAKWGVITTLAQKLPHKKRRRILNTAFNDKEAGFKLRNLNDTSYIARLVADYTETYLEFLPLVESENTTLSKGQKGSKKHIAIVNGVLTSTMRYYLGFASKDRDNHLHHALDAVIIGFMNDSVIKAFSDFKKTQETSKAAYYAHTLSKQEYKKQRAFIQLPSGENFRVSVLEKVESVFVSKPPRKRVRGALHEATFYSPNDPKLLKNYGGTKGVERALALGKMRKVGAKIVSNGAMVRVDIFRHKSSGKFYGVPVYTMDFALGILPNKAVVVGKDQNGVIKDWLEMDSSYEFIFSLYKDDVILVQKKEMQRPELCYFVSFDTSGASIKVAKHDNNFSTLTENQKLLFSNATKEEVVGKSIGIQNLKVFEKWQVSVLGEVKRTQSYPRENISLASKAKK

SEQ ID NO: 460 - protein, 344 aa, Helicobacter pullorum
MKILGFDIGIASIGWAFVENGELKDCGVRIFTKAENPKTGDSLAMPRREARSVRRRLARRKGRLETLKRLLAKEWDLCYEDYIAADGELPKAFMGKNLTNPYVLRYEALQRLLSKEELVRVVLHIAKHRGYGNKNAKITKSEESKREQGKILSALATNASVIARYRTVGEYFYKEFCEVIKNPQGLNTNENCTQPKVRVLKPIRNKGGEYTNCILQEDLQRELRCIFEHQKGFGFSITQEFQDKILKIAFYQRSLKDFSHLVGKCTFYPDEPRAPKFSLSAIEFITKAKAINLLASIAKESGEVWDKEQWRERLDSVFSAVCERGINTIPSSSHFLNIFDILYL

SEQ ID NO: 461 - protein, 1688 aa, Ignavibacterium album
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 462 - protein, 1354 aa, Indibacter alkaliphilus
MKKILGLDLGTTSIGWAFIKEPEKDVVGSEIVDMGVRIVPLSSDEENDFAKGNTISINADRTLKRGARRNLQRFKQRRNALLETFKEKNLIPSNFQYAEDGPSSTFSTLKLRDKAAKEKIELDDFVKVLLQINKKRGYKSSRKAMSEEDEGTAIDSMGIAKELYENDLTPGQWVYEALKNGRKNVPDFYRSDLQEEFKKIVNYQSEFYPDILNTSFVEDWMGKASTPTKQYFNKRGVQLAENKGKREERRLQEYKWRAEAVNFKIDLSEIALILSQINSQISNSSGYLGAISDRSKELYFKNLTVGQYLYQQVKKNPHTRLKGQVFYRQDYLDEFEKIWSVQSSFYPQLNDELKQEVRDVTIFFQRRLKSQKHLISNCEFEEHHKVVPKSHPIFQEFRIWQNLNNLTLIKKDNLNEKCELALEDKTALANELAFKKELSVKDALKVLGLKPSDWEFNFTKIEGNRTNHAFFEAFAKIIELEDGEPIDLGNLKADDILDQFSEAFLRIGIDTELLQVNSDIEGAEYEKQSYIQFWHLLYSSEDDQKLKQNLIRKFGFKPEHAKILASISLQDDHASLSSRAIKKILPHLQSGLIYDKACTYAGYNHSSSFTKDENEKRELRAELELLKKNSLRNPVVEKILNQMINVVNAILKDPNLGRPDEIRVEMARELKANAEQRKNMTSNIASATRDHEKYREILKKEFGLKRVTKNDLLRYKLWLETDGISLYTGKPIEASKLFSKEYDIEHIIPKARLFDDSFSNKTICERQLNIDKANVTAFSFLQNKLSADEFEQYQSRVKSLYGKLSKAKIQKLLMANDKIPEDFIARQLQETRYISKKAKEILFEITMRVSVTTGTITDKLREDWGLVEIMKELNWEKYDKLGLTYTIEGKHGERLNKIKDWNKRNDHRHHAMDALTVALTKPAYIQYLNNLNAKAIGNKKGTEIFAIEQKYLKRENGKLCFIPPIENIRAEAKKHLSKILVSYKAKNKVVTINKNKTKKKAGFNEQTALTPRGQLHKETVYGKSFHYSTKFEKIGASFDAQKINTVAKKEEREALLKRLAENGNDPKKAFTGKNSLNKMPIYLDLGKNIKLSEKVKTVVLEQNYTIRKNIDPDLKVDKVIDVGIKRILESRLEEFGGNAKLAFSNLEENPIWLNKEKGIPIKRVKISGVSNVESLHVKKDHFGEKILDEEGNEIPVDFVSTGNNHHVAIYEDEDGNLQDEVVNFYEAVIRRNQGESIIKYRHEEGWNFLYSIKQNEFFVFPSQDFNPNDFDLLDPKNYDLISPNLYRAQKFSKVMYGNSAVRDYVFRHHLETVLNDVKELKDVAYKQLKSLQYLNGIKKVRLNHLGQIIQVGEY

SEQ ID NO: 463 - protein, 1397 aa, Joostella marina
MKKVLGLDLGTNSIGWALVNEATKEEKKEGKSSEIIKLGVRVNPLTVDEKTNFEKGRPLSTNADRTLKRSARRNLQRYKLRRRNLIEILIKNGFITKDTPLTETGKDTTHQTLKLRAKSAKEKVDLKDFAKILLTINKKRGYKSSRKVNSDEDGLAIDGMAVAKHLYEQNLTPGQYVLNLLQKNKKYVPDFYRSDLQEEFKNIWNNQKTYYFDILTDTLFEELKDKNKSQTWAICKKPFDIAGIKQIGKASDKRLERYKWRTEGLTQKLNLEYLAIALQEINNDINKSSGYLGAISDRSKELFFNKETVGENLYRQLVKTPHTSLRNQVFYRQDYLDEFETIWETQAKFYPQLTHTLKEEIRDVIIFYQRKLKSQKSLISFCQFESWEQTYIEKETGKSKTRTVGRKVIPKSSPLFQEFKIWQNLNSLEFRNSDEGEIIEFIKLDEDIRQTVFEELNLRGNLKPNDVLKILGNYISLGKVSQWKCNFEEIEGNRTNAALYNVYQIIAENEGYGFDWAKKTASEINKELKNIFPQLGIDASILDFDFTQANFDKQTSYQLWHLLYSAEEDFKISEEDKVLYGNSSVSLKKKLHQKYGFKPEYTKLLTNISLQPDYGNLSAKAICNILPYLKENNVYSEACDLTGYNHSNFLTAEEQAKRPLKPILELLKKNSLRNPVVEKILNQMVNVVNQVIETYGKPDEIRIELTRELKKSAKERANMTKSIADATRRNDDYRKTIIKEFGIPNPTKSDVVRYRLWQELASRGYKDIFTDTEIKPQELFSNKIDIEHIIPKALLFDDSFSNKTLAFKKDNLKKANRTAYDFIANDYAPNLENYIERVESLHKDRKITRAKRNKLLMLQSKLPDGFIERDLRNSQYITKEAKKMLYEVCRTVVSTSGSITDKLREDWDLINVMKELNFPKYKALGLTEKIERYDIGAEKMKEVEIIEDWNKRNDHRHHAIDALTVAFSTHSHIQYLNHLNARRDEGHKKHAAIIAIESTITEKEGNKKRRFIAPLPNFRLQAKEHIESILVSFKNKNKVVTNNINKTKRIKKDKFNTKVQLTPRGQLHKETIYGKIKQPLEKHIKLNKSFTLEQAKLIIDKRQREKVLNHLEKYAHNSDIAFNSKTLKKNPLLISDEPLKEVLCFEEVFTIRKDISYDNFKNEKQLDKVIDEKVKQALKERINQYNGDFREAFSDIERNPIWLNKAKGICVKRATIKGVSNAEPLHTAKNHLGEEVLTENKEQIPVDYVSTGNNHHVAIYEDEDGNLQEKVVSFYEAVIRVNEGLPIIDKEYNKSLGWTFKFTMKQNEMFVFPSEDFNPTEIDLLDQKNASLISPNLFRVQKFTIKDYFFRHHLETTVENNNTLKNTTWRREGLSGIYGIIKIRLNHLGEIVQVGEY

SEQ ID NO: 464 - protein, 1060 aa, Kingella kingae
MAAKSLNYILGLDLGIASCGWAVVEMDEQENPLRLIDVGVRTFEEAENPKDGSSLAETRRLARAQRRLISRRANRMNKLCRLLKQENVLQANDYDEKGLIIGLPNQAWELRAQGLDRKLEPKEWAAVLIHLVKHRGYLSQRKNESQTADKELGALLSGMNHNHQLLQSQSNQYRTPAELAIKQFATQDGHIRNQRGAYTHTFNRLDLQNELNQLFDAQTRLGNPHVSGSLKTAINDLLMNQKAALSGDAILEMLGRCTFEPSEYKAAKNTYSAERFVWLGKLTNLRIQDNGLESALSREQRELLLNEPYNKTKLTYQQVRKLLRLPETAFFKGLRYGKDNAESATFMEMKSYHAIRKSLENKSLKSEWEKLKTQPKLLDLIGTAFSIYKTDDEIAGCLKNQLPENVIIALQGQLNFSNFMELSLKALEKLLPLMEQGLRYDEACTQIYGNRHEKIADKTEKFLPNIPADKLRNPVVLRTLTQARKVINAIIRRYGSPARVHIETGREVGKSFSDRDKLKKQQEENQEQRRRAIDEWKQFFPNAAHEPKAVDILKLRLYQLQQGKCLYSGLPIDVRRLPEKGYVEIDHALPFSRTWDDSFNNKILVLASENQNKGNQTPYEYLRGADNSESWRLFVENVQNCQFSPNKKQKIMAKQLDEKGFLERNLNDTRYVSRFLCQFISEHLHLTGKGKKRVFASNGQITALLRGRWGLSKNREENDRHHAVDAVVVACSTVAMQQKITQFVRYQKGNVFTGERIDKETGEVISIHFPTPWEHFREEVMIRVFDDNPLRTLPEKLPNRPEALHEYVMPLFVSRMPTRKMTGQGHKETIKSAKRLDEKISVLRVPLTQLKLNDLENMVNREREPALYEALKARLEQFKNDPAKAFAEPFFKQGGQQVKAVRVEIVQKSGMLLRKINGVADNGSMVRVDVFEKSGKFYLVPIYAWQVAEGILPNYAVVAHKDESDWILMDESYHFKFALYKNDLLEVQTKKGGIMGYFASLDRATGAITIREHDRDKKKCKDGEHRSIGVKMASSFKKLQVDELGKNIHETRSRKRPNIG

SEQ ID NO: 465 - protein, 1314 aa, Lactobacillus animalis
MLKKDYSIGLDIGTNSVGHAVVTDDYKVPTKKMKVFGDTSKKTIKKNMLGVLLFNEGQTAADTRLKRGTRRRYTRRKNRLRYLQEIFAPELAKVDPNFLYRLEESSLVAEDKKYDVYPIFGKREEELLYHDTYKTIYHLRSALANNDQPADLRLVYLALAHIIKYRGNFLLEGEIDLRTTDINKVFAEFSETLNENSDENLGKLDVADIFKNNTFSKTKKSEELLKLSGAKKNQLAHQLFKMMVGNMGSFKKVLGTDEEHKLSFGKDTYEDDLNDLLAEAGDQYLDIFVAAKKVYDAAILASILDVKDTQTKTVFSQAMIERYEEHQKDLIELKRVFKKYLPEKCHDFFSEPKISGYAGYIDGKVSEEDFYKYTKKTLKGIPETEEILQKIDANNYLRKQRTFDNGAIPHQVHLKELVAIVENQGKYYPFLRENKDKFEKILNFRIPYYVGPLARGNSKFAWLTRAGEGKITPYNFDEMIDKETSAEDFIKHMTINDLYLPTEPVLPKHSLLYERYTIFNELAGVRYVTENGEAKYFDAQTKRSIFELFKLDRKVSEKMVIKHLKVVMPAIRIQALKGLDNGKFNASYGTYKDLVDMGVAPELLNDEVNSEKWEDIIKTLTIFEGRKLIKRRLENYRDFLGEDILRKLSRKKYTGWGRLSAKLLDGIYDKKTHKTILDCLMTEDYSQNFMQLINDDNYSFKETIKNAQVIEKEETLAKTVQELPGSPAIKKGILQSLEIVDEIIKVMGYKPKSIVVEMARETQKTHGTRKREDRVQQIVENLKDANELPEKLPSNAELSDERKYLYCLQNGRDMYTGAPLDYDHLQFYDVDHIIPQSFLKDDSIENKVLTIKKENVRKTNGLPSEAVIQKMGSFWKKLLDAGAMTNKKYDNLRRNLHGGLNEKLKERFIERQLVETRQITKYVAQLLDQRLNYDGNGVELDEKIAIVTLKAQLASQFRSEFKLRKVRALNNLHHAHDAYLNAIVANLIMAKYPELEPEFVYGKYRKAKFKGLGKATAKNTLYANVLYFLKENEVYPFWDKARDLPTIKRYLYRAQVNKVRKAERQIGGFSDEMLVPKSDSGKLLPRKEGLDPVKYGGYAKAVESYAVLITADEVKKGKTKKVKTLVNIPIIDSKKYEADPTAYLASRGYTNVTNSFILPKYSLLEDPEGRRRYLASFKEFQKANELILPQHLVELLYWVNAKDGEQKLEDHKAEFKELFDKIMEFADKYVVAPKNSEKIRRLYEENQDATPMELGKNFVELLRYTADGAASDFKFFGENIPRKRYNSAGSLLNGTLIYQSKTGLYETRIDLGKL

SEQ ID NO: 466 - protein, 1371 aa, Lactobacillus buchneri
MKVNNYHIGLDIGTSSIGWVAIGKDGKPLRVKGKTAIGARLFQEGNPAADRRMFRTTRRRLSRRKWRLKLLEEIFDPYITPVDSTFFARLKQSNLSPKDSRKEFKGSMLFPDLTDMQYHKNYPTIYHLRHALMTQDKKFDIRMVYLAIHHIVKYRGNFLNSTPVDSFKASKVDFVDQFKKLNELYAAINPEESFKINLANSEDIGHQFLDPSIRKFDKKKQIPKIVPVMMNDKVTDRLNGKIASEIIHAILGYKAKLDVVLQCTPVDSKPWALKFDDEDIDAKLEKILPEMDENQQSIVAILQNLYSQVTLNQIVPNGMSLSESMIEKYNDHHDHLKLYKKLIDQLADPKKKAVLKKAYSQYVGDDGKVIEQAEFWSSVKKNLDDSELSKQIMDLIDAEKFMPKQRTSQNGVIPHQLHQRELDEIIEHQSKYYPWLVEINPNKHDLHLAKYKIEQLVAFRVPYYVGPMITPKDQAESAETVFSWMERKGTETGQITPWNFDEKVDRKASANRFIKRMTTKDTYLIGEDVLPDESLLYEKFKVLNELNMVRVNGKLLKVADKQAIFQDLFENYKHVSVKKLQNYIKAKTGLPSDPEISGLSDPEHFNNSLGTYNDFKKLFGSKVDEPDLQDDFEKIVEWSTVFEDKKILREKLNEITWLSDQQKDVLESSRYQGWGRLSKKLLTGIVNDQGERIIDKLWNTNKNFMQIQSDDDFAKRIHEANADQMQAVDVEDVLADAYTSPQNKKAIRQVVKVVDDIQKAMGGVAPKYISIEFTRSEDRNPRRTISRQRQLENTLKDTAKSLAKSINPELLSELDNAAKSKKGLTDRLYLYFTQLGKDIYTGEPINIDELNKYDIDHILPQAFIKDNSLDNRVLVLTAVNNGKSDNVPLRMFGAKMGHFWKQLAEAGLISKRKLKNLQTDPDTISKYAMHGFIRRQLVETSQVIKLVANILGDKYRNDDTKIIEITARMNHQMRDEFGFIKNREINDYHHAFDAYLTAFLGRYLYHRYIKLRPYFVYGDFKKFREDKVTMRNFNFLHDLTDDTQEKIADAETGEVIWDRENSIQQLKDVYHYKFMLISHEVYTLRGAMFNQTVYPASDAGKRKLIPVKADRPVNVYGGYSGSADAYMAIVRIHNKKGDKYRVVGVPMRALDRLDAAKNVSDADFDRALKDVLAPQLTKTKKSRKTGEITQVIEDFEIVLGKVMYRQLMIDGDKKFMLGSSTYQYNAKQLVLSDQSVKTLASKGRLDPLQESMDYNNVYTEILDKVNQYFSLYDMNKFRHKLNLGFSKFISFPNHNVLDGNTKVSSGKREILQEILNGLHANPTFGNLKDVGITTPFGQLQQPNGILLSDETKIRYQSPTGLFERTVSLKDL

SEQ ID NO: 467 - protein, 315 aa, Lactobacillus casei
MFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAARGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDMVDCKINPNAVRTKKISFL

SEQ ID NO: 468 - protein, 236 aa, Lactobacillus casei
MFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAARGGVFAWMVRKDPDGNITPYNFDEKVDREASANTFIQRMKTTDTYLIGEDVLPKQSLLYQSYEVLNELNNVRVNDNKLSSSIFKSSATMITNS

SEQ ID NO: 469 - protein, 1389 aa, Lactobacillus casei
MIIRTYELKTITTIAILKMFQLLTGGLSMTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 470 - protein, 412 aa, Lactobacillus casei
MIKDNSLDNRVLVHPLVNREKDTIFASTRFAKQTNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNPKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKK

SEQ ID NO: 471 - protein, 234 aa, Lactobacillus casei
MKVTKKTETIFKVVKIATSQVAALNKARSRSTAEELSVLTELLKPKFSKVGKNGKITDTPFEVVLPRVPREQLFYNAKYGFFMVNSDTMFHNFQEIWVSRSDQKILQQIRKAKIDYPNVDQDLDNLFHNLADQIVKYFDLYSIAGFKEKISQSQNTFNDLAVDDTDQSVGKITVINELLKGAQANGMTGSLKVLKISTPFGFTQDKSGVLTKDSSIIYQSPTGLFERSVRLTDL

SEQ ID NO: 472 - protein, 566 aa, Lactobacillus casei
MQILTDEVLKQKIAELNAHELKASGIYAAIDDAYTSPSNKKALRQVLSVIDDITNAAGQAPNWLYIETADGDGVPGKRTNSRQRKIQEIYVNAAQELITSSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKK

SEQ ID NO: 473 - protein, 1363 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKMKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKVIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLTAGMINSLANIRYRGWGQFSHKLLNELTLSTGRTVFEELLISSHNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDAKIIAVKAGLSSQLRKELDFPKNREVNHYHHAFDAFLAARIGTYLLKRYPNLEPFFTYGKFKKTEVKKLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 474 - protein, 1360 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGELEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQLEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 475 - protein, 700 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTSGYAKDFNTNKVALNEIFPALQDAYAQVYPDLDITFDENKVNEFKTVLLDEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYEQHHEDLELFKDYLKQLEDDGMAKAIRQLYDRYIDGDDAKPFVREDFVKALTKEVTAHPNAKSPELLERLVQPDFMLKQRNKANGAIPVQMQQRELDQIIKNQSVYYDWLAAPNPVEKHRQSMPYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDSDKQTDIEKIIAWSTIFEDKAIFKTKLNEISWLNAGMINSLANIRYRGWGQFSHKLLNELTLSTGRTVFEA

SEQ ID NO: 476 - protein, 330 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKNRYKYEKRLFNDRTDAEFYQQYPTMYHLRNRLLTDPSKADVREIYFAIHHILKSRGHFLTPGDAKDFNTNKVALNEIFPALQDAYAQVYPDLDITFDENKMNEFKTVLLNEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSQAKVDD

SEQ ID NO: 477 - protein, 330 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTDPNFFMRQKYSEISPKDKNRYKYEKRLFNDRTDAEFYQQYPTMYHLRNRLLTDPSKADVREIYFAIHHILKSRGHFLTPGDAKDFNTNKVALNEIFPALQDAYAQVYPDLDITFDENKMNEFKTVLLNEKATPSDTQRALVNLLLAEDGDKDILKQQKQVLTEFAKAVVGLKTKLNVALGTEVDSSEATAWNFSLGQLDDKWAGIESAMTDEGTEILDQIRDLYRARLLNGIVPAGKTLSHAKVDD

SEQ ID NO: 478 - protein, 1361 aa, Lactobacillus casei
MTKLGKPYGIGVDIGSNSIGFAAVDENSHLIRLKGKTVIGARLFEEGKAAADRRASRTTRRRLSRNRWRLSFLRDFFESHITPTGPNFFMRQKYSEISPKDKARYKYEKRLFNDRTDAEFYQQYPTMYHLRNRLLTDPSKADVREIYFAIHHILKSRGHFLTSGYAKDFNTNKVALNEIFPALQDAYAQVYPDLDITFDENKVNEFKTVLLNEKATPSDTQRALVNLLLAEDGDKDILKQQKQVLTEFAKAVVGLKTKLNVALGTEVDSSEATVWNFSLGQLDDKWAGIESAMTDEGTEILDQIRDLYRARLLNGIVPAGNTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQSVYYDWLAAPNPVEKHRKSMPYQLDELLNFRIPYYVGPLVTAKEQKAAQGGVFAWMVRKDPDGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPDAIDDPAKQADIENIIAWSTVFEDAAIFKTKLKEINWLDSQTITKLSNIRYRGWGQFSHKFLNGLTLGNGHTIIQELFLSNNNLMQILTDETLQKKMTELNADKLKAANINDAIDDAYTSPSNKKALRQVLRVIEDIKRAADGQDPSWLYVETADGGGTPGKRTRARQHQLQEIYANAAHELIDSAVRGELEDKIADKADFNDRLVLYFMQGGRDIYTGTPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPETKIIAVKAGLSHQLREELEFPKNRDVNHYHHAFDAFLAARIGTYLLKRFPNLQAFFTYGKFKKADVKKLRGFNFIRDITHAEDKIVVKDTGEVIWDKKRDVDELDRIYNFKRMLITHEVHFEKADLFKQTVYGAKDSKEAGGKKQLISKKKGYPVDIYGGYTQETGSYLSVVRLTKKAMYAVVKVSTRDAAKLAVAKSISEQKENETLNDIIDEKLSKISKNGKITHELFEVVLPRVGQKTLFKNSKYNLFLVNSDTYMHNYQELWMPREYQKMWKDISLSKYGDAQTEDQLDQIFGFIVSQVNSYFNLYDINQFRKKLNDAADKFATLPMRDTDDMQGKIATIGQLLIGLQANAARSDLRNLDIKTPLGLLQIPNGISLDSDTSVVYQSPTGLLEREVHLSDL

SEQ ID NO: 479 - protein, 1128 aa, Lactobacillus casei
MTKLGKPYGIGVDIGSNSIGFAAVDENSHLIRLKGKTVIGARLFEEGKAAAKRRAGRTTRRRLSRNRWRLSFLRDFFESHITPTDPNFFMRQKYSEISPKDKARYKYEKRLFNDRTDAEFYQQYSTMYHLRNRLMTDPSRADVREIYFAIHHILKSRGHFLTPGDAKDFNTNDVALDEIFPALQDAYAQVYPDLGITFDEDKANEFKTILLNEIATSIDTQRALVKLLLAEEDDKDILKQQKQVLTEFAKAVVGLKTKLNLALGTEVDSSEATAWNFSLGQLDDKWAGIESAMTDEGTEILDQIRDLYRARLLNGIVPTGKTLSQAKVDDYTQHHEDLQLFKAYLKQLEDDGTAKAIRQLYDRYIDGDDAAPFLRENFVKALTKDVTAHPNTKSPELLERLAQPDFMLKQRNKANGAIPVQMQQRELDQIIKNQAVYYDWLAAPNPVEKHRKSMPYQLDELLNFRIPYYVGPLVTAKEQKAAQGGVFAWMVRKDPEGNITPYNFDEKVDREASANTFIQRMKTTDTYLIGEDVLPKQSLLYQRYEVLNELNNVRVNNEKLSIEQKQQVIRELFERHNSVTIKQFAENLRAHGDYAHIPEIRGLADEKRFLSSLSTYRQLKSLLPEAIDDPAKQADIENIIAWSTVFEDAAIFKTKLKEISWLGSEAITKLSNIRYRGWGQFSRKFLNGLTLGNGHTIIQELLLSTNNLMQILTDETLQKKMTELNADKLKTANINDAIDNAYTSPSNKKALRQVLRVVDDIKRAADGQDPSWLYVETADGGGTPGKRTRARQHQLQEIYANAAHELIDTAVRGELEDKISDKADFNDRLVLYFMQGGRDIYTGAPLNIDQLSSYDIDHILPQSLIKDNSLDNRVLVHAIINREKNATFASTIYAQKMNATWRQWHEAGLISGRKLRNLQMRPDQIDKYASGFVARQLVETRQIIKLTEQIVAAQYPDTKIIAVKAGLSHQLREELEFPKNRDVNHYHHAFDAFLAARIGTYLLKRFPNLQAFFTYGKFTKADVKKLRGFNFIRDITHAEDKIVAKDTGEVVWDKQRDVDELDRIYNFKRMLITHEVRFETADLFKQTVYGARDSKEAGGSKQLIPKKKDIQLIFMGAISERTRPILPL

SEQ ID NO: 480 - protein, 1366 aa, Lactobacillus casei
MTKLGKPYGIGVDIGSNSIGFAAVDENSHLIRLKGKTVIGARLFEEGKAAAYRRASRTTRRRLSRNRWRLSFLRDFFESHITPTDPNFFMRQKYSEISPKDKARYKYEKRLFNDRTDAEFYQQYPTMYHLRTRLLTDPSKADVREIYFAIHHILKSRGHFLTPGYAKDFNTNKVALNEIFPALQDAYAQVYPDLDITFDENKVNEFKTVLLNEKATPSDTQRALVNLLLAKEGDRDILKQQKQVLTEFAKAVVGLKTKLNVALGTEVDSSEATAWNFSLGQLDDKWAGIESAMTDEGTEILDQIRDLYRARLLNGIVPAGKTLSQAKVDDYAQHHEDLELFKDYLKQLEDDGTAKAIRQLYDRYIDGDDAKPFVREDFVKALTKEVTAHPNAKSPELLERLAQPDFMLKQRNKANGAIPVQMQQRELDQIIKNQAVYYDWLAAPNPVEKHRQSMTYQLDELLNFRIPYYVGPLVTAKEQKAAQGGVFAWMVRKDPDGNITPYNFDEKVDREASANTFIQRMKTTDTYLIGEDVLPKQSLLYQSYEVLNELNNVRVNDNKLSFDQKQQVLGELFERHNTVTIKQFVDNLLAHGDYDRIPEVRGLADEKRFLSSLSTYNQLKGILHEAIDDADKQTDIENIIAWSTIFEDKAIFKTKLNEISWLNAGMINSLANIRYRGWGQFSHKLLNELTLSTGRTVFEELLISSRNLMQILTDEVLKQKIAELNAHELKASGIYAAIDDAYTSPSNKKALRQVLSVIDDITNAAGQAPNWLYIETADGDGVPGKRTNSRQRKIQEIYANAAQELITGSVRGEFEDKIASRADFTDRLVLYFMQGGRDIYTGEPLNIDNLSSYDIDHILPQSLIKDNSLDNRVLVHPLVNREKDTIFASTRFAKQMNGMWRQWHAAGLISSRKLRNLQMRPDEIDKYASGFVARQLVETRQIIKLTEQIVADQYPDTKIIAVKAGLSSQLRKELDFPKNREVNHYHHAFDAFLAARIGTYLLKRYPNLEPFFTYGKFKKTEVKKLKSLKSLKSFNFIRDMTHAKDKIVAKETGEIVWDNASDINELDRIYNFKRMLITHEVRFETASLFKQTLYAAKNSKNRGGSRQLIPKKKGYLVDIYGGYTQETGSYLSVVRLTKKAMYAVVKVSTRDAAKLAVAKSISEQKENETLKKIIDGKLSKTSKKGKTTHQLFEIVLPRVGQKTLFKNSKYNQFLVNSDTYMHNYQELWMPREYQRMWKDILLSNHGDAQIEGQLDQIFKFIVSQVNSYFNLYDINQFRKKIADATDKFAKLPTHDTDNARGKIATIGQLLIGLQANAMRSDLRNLDIKTPFGLLQIGTGITLDLDTSIIYQSPTGLFEREVPLTDL

SEQ ID NO: 481 - protein, 1354 aa, Lactobacillus coryniformis
MTLHYNVGLDIGTNSVGYTIVDDNGKILQVKGKNGYGVRVFKEGATAAERRIFRTTHRRLKRRKWRLRLLQDFFEPYILPQDDGFFIRRKESNLVLNDRDEDTASLFNDRSDRDFYQAYPTIYHLRQALMTEKRQFDVREIYLAMHHIIKYRGHFLLNGTVNNFTNNKIDLHSDFEELNALLLNVIPELKFQIDLDHSTMFQTTLLNTTISRSGRQRDLVKSFYNGSDDKQLAKQQKSVATELLKAILGLKAKFHKLFNLDLLETTEWEFSFDAEDIDDKLAKLEPLMTENQQQVMDILQRIFAAITLNGIVPEGKTLSASKVDSYQKHKQDLKLLKAIAQHSDKKTATVLQTAYNEYINGIASKPLKQEDFYKRLTNAVKKSSDPQVADMLALIDQEKFLPKQRTKENGAIPHQLHQLELERIIDNQKDYYPWLAELNPNQARQKVAKYKLSELVAFRVPYYVGPLIEPEVQQATSNAHFAWMARKEAGPITPWNFDQKVDRNVSAERFIKRMTTKDTYLLAEDVLPLHSLLYQRFIVLNELNNVRVNGQKLTKKQKQAVYQDLFKRQPHVTKKQFKSYLVQTGEFAESSKIEGLANETSFNSGLTTENELRKIFGAQLDEARYQVDFEQIIEWATLFEDAKILRTKLAEITWLTTEQIEKLAGIRYRGWGRFSRKLLAGLRDQNGQQIIDLLWDTPNNFMVIVSQAAFSEAITKENEKLIDRRGAQDVITDLYTSPQNKKALRQVLAIVADVQKAMGGVPPQRIFIEFAREDEKNPRRSVERSRQLEKLYQTISNEFLINSEVRQELKEAVDQKVNFKDRLFLYFLQGGVDLYSGKRINIDQLSHYDIDHILPQSFIKDDSLDNRVLVSQKLNRSKSDSVPLSEFANYKFGPAMQAKWLQLKEAGLLSKRKYDNLTLDPTKLSKFAPLGFVNRQLVETRQVIKLAANLLASEETKVVTIKANMTHQVRKELDFPKNRNVNNYHHAFDAYLTAFVGIFLSKRYPKLKPYFTYGDFQKGNKLPDLKNFNFLYELKNKDRSIDSNTGEIIWDKQRDLAYMNKIYNFKKVTVVHEVLTKSGALYNQTLYKASEDKASGRGTKQLIRKKDNMPTELYGGYTGSTSAFMSIVRLWKKDKPYYKVVGIPTRMAAKLANQAQLLDYLTKKFTTRKLVKKTGDYKTTVERFELVVPKVGFNQLVIDGGQPFMLGSATYQYNARELFISKEAVKALNKQLSTHVDLVQVFDEILVQVNRWFPLYDTNGFREKLSHGRDRFMKLNDSFEEKSDTQIDVLNRILIGFHANAARTNLKILGLGTDLGFMTQQAGIRLTEKAILVHQSPSGLFERKVALRDLKGLR

SEQ ID NO: 482 - protein, 544 aa, Lactobacillus crispatus
KYYLYFMQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 483 - protein, 298 aa, Lactobacillus crispatus
MDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKTSFQMNKNDQDFLF

SEQ ID NO: 484 - protein, 279 aa, Lactobacillus crispatus
MNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKYYTR

SEQ ID NO: 485 - protein, 538 aa, Lactobacillus crispatus
MQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 486 - protein, 206 aa, Lactobacillus crispatus
MQLGRDAYTGKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKRK

SEQ ID NO: 487 - protein, 857 aa, Lactobacillus crispatus
MTKLNNEYMVGLDIGTNSCGWVATDFDNNILKMHGKRALGSHLFDEGVSAADRRAFRTTRRRIKRRKWRLKLLEEIFDEEMAKVDPNFFARLKESGLSPLDTRKNVSSIVFPTKKMDKQFYKKFPTIYHLRNALMKQDKKFDLRAIYIAIHHIVKYRGNFLSNSSISNFSASKIEIDRFVNELNDLYSIFLPESGVIFDAGNASKVEDIIRNEQMFKLDKIKEIADVLPDTENKSGLKLSKKISKEISKAILGYKAKFEIILQVNVDKTDSSIWNFKLNDENADVNLSEITSDLTDTQLQILDLVRNLFSAISLLNIVDEGSTLSESMIRKYNDHAQDLKLLKTVIKNHSDRKKAHNLQLAYDKYVNNRHFVDVETKKAFPNKHLYRKSDFYEIVKKNLDASKEAVQIRKEIALDKFMPKQRSDENGVIPFQLNQIELDKIIENQGKYYPFLKEINPIKAHRMQAPYKLDELIRFRVPYYVGPMIEPTNSSYPQTRQNQSFAWMVRKAKGRITPWNFDEKVDRQKSANNFIKRLTTKDTYLFGEDVLPANSLLYQKYTVLDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKTSFQMNKNDQDFLF

SEQ ID NO: 488 - protein, 857 aa, Lactobacillus crispatus
MTKLNNEYMVGLDIGTNSCGWVATDFDNNILKMHGKRALGSHLFDEGVSAADRRAFRTTRRRIKRRKWRLKLLEEIFDEEMAKVDPNFFARLKESGLSPLDTRKNVSSIVFPTKKMDKQFYKKFPTIYHLRNALMKQDKKFDLRAIYIAIHHIVKYRGNFLSNSSISNFSASKIEIDRFVNELNDLYSIFLPESGVIFDAGNASKVEDIIRNEQMFKLDKIKEIADVLPDTENKSGLKLSKKISKEISKAILGYKAKFEIILQVNVDKTDSSIWNFKLNDENADVNLSEITSDLTDTQLQILDLVRNLFSAISLLNIVDEGSTLSESMIRKYNDHAQDLKLLKTVIKNHSDRKKAHNLQLAYDKYVNNRHFVDVETKKAFPNKHLYRKSDFYEIVKKNLDASKEAVQIRKEIALDKFMPKQRSDENGVIPFQLNQIELDKIIENQGKYYPFLKEINPIKAHRMQAPYKLDELIRFRVPYYVGPMIEPTNSSYPQTRQNQSFAWMVRKAKGRITPWNFDEKVDRQKSANNFIKRLTTKDTYLFGEDVLPANSLLYQKYTVLDELNKISVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLSVWEKNSFQMNKNDQDFLF

SEQ ID NO: 489 - protein, 347 aa, Lactobacillus crispatus
MVNLKSLVLILKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 490 - protein, 534 aa, Lactobacillus crispatus
RDAYTDKPINIDEVSQYYDIDHILPQSFIKDDSLNNRVLVAKPINNGKSDGVPLKLFGDNLATGLGITVKQMWNNWADKGLINKAKQNNLFLDPENINKHQASGFIRKQLVETSQIIKLATTILQAEYPKTKIIVVKASSNHYLRNEFDLYKSREVNDYHHAIDAYLTTICGNLLYQAYPKLRPFFVYGQFKKFSSDPKKENEILKKTKNFDFVAKLLGSKAPNEIRSQQGKVLFEKNKIRLQLNKAYNYKYMLVSRDTTTKNQEMFGMTIYPRAERDIAKSRKLIEKRKGFSTDIYGGYTGTAAAYMAIVRINKTKSSQYKVIAVPMTKRAILNKAEKEGNYEKILKQILSPSILYNDKGKRKAGVISFDIIKGKVPYNQVVQDGNKKFLLKSAIYLCNAKQLVLSEEAMRVITGHWLDSDKQDQELLDVYDEILEKIDRYLPLFDIRDFRNKLHKGREKFLKLNAEDKFKAIIQILKGLHDNSDTGELKDIGITVPFGQLQNNSGITLSSDTILVYQSPTGLFEKRVKISSL

SEQ ID NO: 491 - protein, 278 aa, Lactobacillus crispatus
SVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKYY

SEQ ID NO: 492 - protein, 277 aa, Lactobacillus crispatus
SVNGKKLSVSVKQELYEDLFKKNNTVSAKQLKNWLIENQKLPYIKIKGLADQTKFNSSLSTYIKLKKSGLFVDKLDSNEFRDDFEKIIEWSTIFEDKQIYIQKLQTIDWLTAKQIQFLQNIRLQGWGRLSKKLLTAIVDSNGQNIIEQLWNSQQIFMSIVNKADIKGTITDANQDLMHSNSMEDILSEAYTSPANKKMIRQVVKVVHDIQKAASGQAPKQIAIEFARESRRNSKLSQTRGHKLQDIYQKISGDIVNKNLKDKLAEYIKNNQLNKDKY

SEQ ID NO: 493 - protein, 1368 aa, Lactobacillus curvatus
MSRPYNIGLDIGTSSIGWSVVDDQSKLVSVRGKYGYGVRLYDEGQTAAERRSFRTTRRRLKRRKWRLGLLREIFEPYITPIDDTFFLRQKQSNLSPKDQRKLYTQTSLFNDRTDRAFYDDYPTIYHLRYRLMTEKRQFDIREIYLAMHHIVKYRGHFLNEAPVSSFKSSEINLVAHFDRLNTIFADLFSESGFQLETDKLAEVKALLLDNQQSASNRQRQALSLIYTPSTNKAVEKQNKAIATELLKAILGLKAKFNVLTGIEAEDVKAWTLTFNAENFDEEMVKLESSLDDNAHQIIESLQELYSGVLLAGIVPENQSLSQAMITKYDDHQKHLKMLKAVREALAPGDRQRLKQAYDQYVDGQENTKAYSKEDFYGDITKALKNNPDHPIVSEIKKLIELDQFMPKQRTKDNGAIPHQLHQQELDRIIENQQQYYPWLAELNPNSKRQTVAKYKLDELVAFRVPYYVGPLITAEQQRQSSDAKFAWLIRKAEGRITPWNFDDKVDRQASANEFIKRMTTTDTYLLAEDVLPKQSLIYQRFEVLNELNGLKIDDQPITTELKQAIFTDLFMQKISVTVKNIQDYLVSEKRYASRPAITGLSDENKFNSRLSTYHDLKMIVGDAVDDVDKQADLEKCIEWSTIFEDGKIYSAKLNEIDWLTDQQRVQLAAKRYRGWGRLSAKLLTQIVNANGQRIMDLLWDTTDNFMRIVHSEDFDKLITEANQMMLAENDVQDVINDLYTSPQNKKALRQILLVVNDIQKAMKGQAPERILIEFAREDEVNSRLSVQRKRQVEQVYQNISNELLNNTEIRNELKDLSNSALSNTRLFLYFMQGGRDMYTGDSLNIDRLSTYDIDHILPQSFIKDNSLDNRVLVSQKMNRSKADQVPTDFTSVELGQKMQIQWEQMLRAGLITKKKYDNLTLNPDHISKYAMKGFINRQLVETRQVIKLATNLLMEQYGEDNIELITVKSGLTHQMRTEFDFPKNRNLNNHHHAFDAYLTAFVGLYLLKRYPKLKPYFVYGEYQKASQQDKWRNFNFLNGLKKDELVDENTEAVIWDKESGLAYLNKIYQFKKILVTRGVHENSGALFNQTLYAAKDDKASGQGGKQLIPAKQDRSTALYGGYSGKTVAYMCIVRIKNKKGDLYKVCGVETSWLAQLKQLTDEDSQKAFLEQKISPQFTKVKKQKGNIIEAVEEFEVIAPHILINQRFFDNGQELTLGSATYKHNEQELILDKTAVKLLNGALPLTQSEELAEQVYDEILDQVMHYFPLYDTNQFRAKLSTGKAAFMKLPWKSQWDGNKMVQVGQQVILDRILIGLHANAAMSDLKVLKMTTPFGMIQQSTGITLSADTQIIYQSPTGLFERRVALRDL

SEQ ID NO: 494 - protein, 669 aa, Lactobacillus delbrueckii
MAKPKDYTIGLDIGTNSVGWVVTDDQNNILRIKGKKAIGARLFTEGKVAAERRSFRTTRRRLSRRRWRIKMLEELFDEEIAKVDPSFFARLHESWISPKDKRKRYSAIVFPSPEEDKKFHESYPTIYHLRDKLMKDDQKHDIREIYIAVHQMIKARGNFLHDESVETYRSGMSSLGGRSERNILSVQTLEELNDLFAENEGTEEVELNVASAEQINDILTGGHLNADSQKEISNLLLPSSFPSFDDKAKEKQVKKLINNVATNISKAWLGYKADFSTILNLAKVDKDQKKIFAFALQGGDEEDKVQELESLLEQSQTDIVDRLIEIRHAIVLSEIVPVGMTLSEAMIDKYDQHKEDLITLKAVIRNTKDKKKAAKLQAIYDLYVKKRHADLAKAMKLTGIKKRSELLDPEELKKGISSLLDDSPEAVEIKQRLEEKTFLPLQRSNNNGVIPNQLHQVELDEIIKKQSKYYPFLAEKNPDESEEAQKKAPTKLDALLTFRVPYYVGPMITKEEQEAQNGHSFAWMVRRDPQDHEAITPWNFEKKVDKMASATQFIKRMTTKDTYLLGEDVLPASSLKYQLFTVLNELNNLRVNGKKLTSDEKEQVIEGLFKKQKTVKADKFVKYWQAKHIGADIKVKGLSDPSKFNSTMSTYIDFKKIFGDQLNDVNRQR

SEQ ID NO: 495 - protein, 544 aa, Lactobacillus delbrueckii
MTGCADYDVDHIMPQSFVKDDSLDNRVLVARAVNNQKSDKVPALLFGNKVVADLGITVREMWDKWQKLGMISKRKLSNLLTDPDALTEYRAQGFIRRQLVETSQVIKLTATILQSEFPDSKIIEVPAKYNSIVRKQFDLYKSREVNDFHHAIDAYLSTIVGNYLYQVYPNLRRMFVYGEFKKFSSNAEESAHDVARRVKSMNFLDDLLRGTHGDNIYCRSTGEIVFNRNDIISKLKQAYSFKQMLVTQEVFTKKSALFDQTVYPSPERDSKKRSGLIPRKKGMDTEIYGGYSGNKDAYFVLAEAVKEKGHTLQIVGVPIRALNTLKNSANYSEKLLEIIKPQVMFNKDTGKPIKGIKDVKILMDKIPCRQPVLEGESYYMLASSKYRYSLKQISLSQMSMKYILDYIDDPNFNKHEMINIDQQDEKECLLSVYDEILEKMDKYLPLFDIRSFRKKLHDGRDAFIALPVASEEKKPGEVDVIRKILKGLHANADITNLAELGFGTAALGALVSTGGIKISDDAVFIYQSPTGLFERRVKVSDLLK

SEQ ID NO: 496 - protein, 1356 aa, Lactobacillus farciminis
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 497 - protein, 1313 aa, Lactobacillus fermentum
MHYLDEIFAPHLQEVDENFLRRLKQSNIHPEDPAKNQAFIGKLLFPDLLKKNERGYPTLIKMRDELPVEQRAHYPVTNIYKLREAMINEDRQFDLREVYLAVHHIMKYRGHFLNNASVDKFKVGRIDFYKSFNVLNEAYEELQNGEGSFTIEPSKVEKIGQLLLDTKMRKLNRQKAVAKLLEVKVADKEETKRNKQIATAMSKLVLGYKADFATVAMANGNEWKIDLSSETSEDEIEKFREELSDAQNDILTEITSLFSQIMLNEIVPNGMSISESMMDRYWTHERQLAEVKEYLATQPASARKEFDQVYNKYIGQAPKERGFDLEKGLKKILSKKENWKEIDELLKAGDFLPKQRTSANGVIPHQMHQQELDRIIEKQAKYYPWLATENPATGERDRHQAKYELDQLVSFRIPYYVGPLVTPEVQKATSGAKFAWAKRKEDGEITPWNLWDKIDRAESAEAFIKRMTVKDTYLLNEDVLPANSLLYQKYNVLNELNNVRVNGRRLSVGIKQDIYTELFKKKKTVKVSDVASLVMAKTRGVNKPSVEGLSDPKKFNSNLATYLDLKSIVGDKVDDNRYQTDLENIIEWRSVFEDGEIFADKLTEVEWLTDQQRSALVKKRYKGWGRLSKKLLTGIVDENGQRIIDLMWNTDQNFMQIVNQPVFKEQIDQLNQKAITNDGMTLREWVESVLDGAYTSPQNKKAIWQVVRVVEDIVKAVGNAPKSISIEFARNEGNKGEITRSRRTQLQKLFEDQAHELVKDTSLTEELEKAPDLSDRYYLYFTQGGKDMYTGDPINFDEISTKYDIDHILPQSFVKDDSLDNRVLVSRAENNKKSDRVPAKLYAAKMKPYWNQLLKQGLITQRKFENLTMDVDQNIKYRSLGFVKRQLVETRQVIKLTANILGSMYQEAGTDIIETRAGLTKQLREEFDLPKVREVNDYHHAVDAYLTTFAGQYLNRRYPKLRSFFVYGEYMKFKHGSDLKLRNFNFFHELMEGDKSQGKVVDQQTGELITTRDEVAKSFDRLLNMKYMLVSKEVHDRSDQLYGATIVTAKESGKLTSPIEIKKKRPVDLYGAYTNGTSAFMTIIKFTGNKPKYKVIGVPTTSAVGLKRVGKPGSESYNQELHRIIKSNPKVKKDFEIVVPHVSYSQLIVDDDCKFTLASDTYQHPATQLVLSKESMEIIADDFKFVKENTATADEQLVRVFDEIVNQMNHYFTIFDQRSNRQKVTKARDKFVSLPTESEYEGAKKTQVGKTEVITNLLMGLHANSAQGDLKVLGLSTFGFFQSSGGLNLSEDAMIVYQSPTGLFERRICLKDI

SEQ ID NO: 498 - protein, 1327 aa, Lactobacillus florum
MTEQQQPYNIGLDIGTSSIGWAVTDQNDKLLHIRGHNGIGVRLFKEGESAAERRGFRTTRRRLSRRRWRLRFLDRIFDAELAKVDPNFLARLKQSNISPLDPNKQMFGNILFDDPQFDDQKFHQQYPTIYHLRSALAQPDAPQADVRLIYLALHHMIKFRGHFLNGAAVEKFHGGQLHLESEFQELNQIFSNQQRDHVQLQTSSLDEVATILKDNQRTPSDRQRELSARLFVPVDKTIDKENKKLATELLKAVLGLKAKFDVILGVEATDPQAFKLQFSSDDFDDKIAELASELTDEANEILTVLQRLYFSLNLADILTNRQTKQVADSISTAMINRYDDHKHHLKMLKELEAQVTQEQRDGLKKAYDEYIDGDKPTIDTFYTNIKKNLDDSELANQIKSLIDLQAFMPKQRSKENGSIPHQLHQRELDQLIEVQGKYYPWLLAAKDKLDALIAFRVPYYVGPMIDPNQSDDPQNTKFAWMVRKEAGEITPWNFEEKVDKTSSATNFIKRMTTTDTYLLGEPVLPKNSLLYQQFTVLNELNKLKVNGKALTVDQKKYLYEHVCKKQRRVTLKKLSDCLMARGDFPMGAIFTGTTDQKNMNNTLKTYQDFQEIFGDEIDNPDRQVDFEKMIEWSAIFEDREIFKLKLAELNWLTSEQLERVSKKRYQGWGRLSQKLLTHIVNENGERIIDQLWNTNQNFMEIMGQDSVKQAIQEHNGANVAQTGINETIDELYTSPQNKKAIRQILLVVDDIKKAVGYAPANIMMEFAREDRDDHRLIASRARQLEKTYQEISKNWFDNESVTQELKDQIKNKTKFTDRLYLYFIQGGIDLYTGHPLNIDQLSSYDIDHILPQSFLLDNSLNNRVLTSQAENRVHKEDRLPGETVANKMRPTWKMMREQGLMTQRKYNNLTLKPDQISKFNNRGQFINRQLVETRQVIKLAADIMSQKYQADQTKVVTVKANLTHHMREKFNFYKSRNVNDYHHAFDAYLTLFVGNWLLKEYPKLQPYFVYGDFAKTGTNNLKSFNFLYRFERDHKLNDKGAIDTDKDQQLGYMKRIYRFKKMLVTKQLETNEGALYGQTLYPAPKNDKKTRNLINSKKNRPSDIYGGYSNENGSFLTLVKLKKGSKYDYRLVAVPVSKISEIKESELATIEKAIAPQFLKSSGKYRDFQVVLSKILINQKVIDDGMIFTIGSKSYKHNAKQVVLSDNSIQIVSTLSRISDKEKLITVFDEIVDITSKYLPWYKVNDVEKTKMLFRQMQDIDEMKKIIDNSLIGLHCNASITDLGKVGLSKYWGRFVLTAGISLTVDAQLIYQSPTGLFEHRVKVSDL

SEQ ID NO: 499 - protein, 1386 aa, Lactobacillus hominis
MTKITEDYIVGLDIGTNSCGWVAMDSKNTILRMHGKTAIGSHLFDAGNSAADRRAFRTTRRRIKRRKWRLKLLEEIFDSHLAKVDPYFFARLKESGLSPLDTRKNVSSIIYPTSLEDKKFYVDNPTIYHLRYKLMTEDRKFDLREVYLAIHHIVKYRGNFLYNTPVKAFEASKIDVKGSLKKLNELYEGLDSEFNVELDSNNALEIENIIRDKKIFKINKVKEINQLLSLKTEDKERTKLMKDVSKQIVNAILGYKTKFETILLKDVSKDEADDWEFKLTDVDADNKFENLIGDLNENEQEILLVIRKLANAITLSNIVEEGKTLSESMKDKYKKHSDDLKLLKQVISDHPDRDKAKKLALAYDLYVNNRHGKILQAKDILEKKKTLSKEDFYKEIKKNLDDSKESQEILDAISLDSFMPKQRTNENGVIPYQLHQLELDKIIENQGKYYPFLKEVNPVSSHLKQAPYKLDELIRFRVPYYVGPLISPNESTKNKQTKKNQNFAWMIRKEQGQITPWNFDQKVDRMASANKFIKRMTTIDTYLLGEDVLPANSLLYQKFTVLNELNNVKINGKRISVPLKQELYNNLFKKNSTVTTNKLKSYLKENYKLIKVEIKGLSDEKKFNSGLTTYNKLKNLKIFDQQIDDPNYNKDFERIIEWSTIFEDKAIYKEKLKTIDWLSDRQIDKLSKIRMQGWGQLSKKLLSQLTDNNGQTIIEQLWDSQNNFMQIVNQADFKDAIAVANQNLLVDTSVEDILNEAYTSPANKKAIRQVVKVVDDIVKATSGKVPKQIAIEFTRDADDNAKISQSRANKLRKVYKEMSNELASETIRNELERVAKDQKLLKDKHYLYFMQLGRDAYTGELIDIDNLEQYDIDHVLPQSFIKDDSLENRVLVKKAVNNGKSDNVPVKLYGNRMATDLGMTIRHMWEKWKEQGLITKTKYNNLIIDPDKINKYESSGFIHRQLVETSQIIKLVSTILQSKYPDTEIIVVKARYNHYLRKRLNLYKSREVNDYHHAIDAYLSAICGNLLYQVYPYLRPFFVYGQYKKFSSEPEKEKIIYDKTRRYNFISQIFENKDNDIISRETKKKVFDKKDIIEKLKRAYNYKYMLVSRETETHDQEMFKMTVYPRLSRDTKKSRNLIPKKKDMPTEIYGGYTNNSDAYMIIARINKKKGPEYRVFGVPMRELVNLRKAEKNGHYKAYLKQVLEPEIMYSKNGKKNKTISSFEIVKAKVPYKQVILDGDKKFMLASSTYVQNAKQLTLSQYSMQAITDNCENDTEEEKALVEAYDEILTNIDKYLPLFDINKFREKLHAGREKFVDLPLAEKKETILQVLNGLHDNAVMPKIKSLGLSTPLGFMQFHTGVSLSENAKLIYQSPTGLFEKRLKISDL

SEQ ID NO: 500 - protein, 270 aa, Lactobacillus iners
MITYLKDNDDITLSFPKDQLINIFKNSNLNSTEKSDQLKPFFGRTNLEKGIIKLLSGGKQDLSNMFRDETLKNSNYKNLKFSDNRFDDERDGYAADLGDRIDLLILLKQIYDASILESMMSQARVSIDGHKYISSAKVCAYEKHKSDLKRLKSLIKKYLPSEYNNIFRKITEKDNYVAYSKSNITNNKREKALKYVKYVDFTKYLTKKLKTIKTQDAEDDQEIFEIKGELEKQSFLPKQRTLDNSIIPYQLHLMELKKYLIINLNIMTFC

SEQ ID NO: 501 - protein, 255 aa, Lactobacillus iners
MITYLKDNDDITLSFPKDQLINIFKNSNLNSTEKSDQLKPFFGRTNLEKGIIKLLSGGKQDLSNMFRDETLKNSNYKNLKFSDNTFDDERDGYAADLGDRINLLILLKQIYDASILESMMSQARVSIDGHKYISSAKVCAYEKHKSDLKRLKSLIKKYLPSEYNNIFRKITEKDNYVAYSKSNITNNKREKALKYVEYVDFTKYLTKKLKTIKTQDAEDDKEIFEIKGELEKQSFLPKQRTLDNSIIPYQLHLME

SEQ ID NO: 502 - protein, 343 aa, Lactobacillus iners
MLAKDDQEGITVKDKIISLLTFRLPYYIGPVNPAVHGKFAWVKRLANGKVTPWNYKEKIDIDASHEEFIKTKLSKCSFLIGCDVLPKNSLLYQKYMVLSELNTIKFNGVNISEKLKDDIYQNLFKNIQKVTKKRLQNYIKEHENIIGDVIVTGIDNAFKQGLVSYLKFKKIIGDKIDDDRYQKVLEKIIRDITLYDECAGKKIKKEYKDSDLFTEDELNKIVKLTFNDWGRLSAELLDQLEGEDTVSGETGKIIEFMQKHNYNLMQLMSKKFTFKYKIDEINKSYYQHDKFNYKSMIDSLYVSPATKRILWQSLKVVHEISKIMKHDPEKIFYRNGTFQRRSS

SEQ ID NO: 503 - protein, 447 aa, Lactobacillus iners
MLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDSKTNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVISKYTNSVFGKSMLISDKYRKDIFKSVDKSILEFNSLNTIAKADNLLKFVTSMRPAGSVDALKMVGLIERIRKSNVISNFNEFKLINQSVTGLFENEEDLLKL

SEQ ID NO: 504 - protein, 667 aa, Lactobacillus iners
MQKHNYNLMQLMSKKFTFKSKIDEINKSYYQHDKFNYKSMIDSLYVSPATKRILWQSLKVVHEISKIMKHDPEKIFIEMARSKEDHPKRKLSRKADLKQVYKDSKKQIISIIGKDKYQDLSNELDNKDDRDLRWDNLYLYYTQLGRSMYSLKPIDISELMNKNLYDQDHIFPKSKKYDDSIENRVLVEKELNVKKSDIYPISDANIIPQKIKGQVESFWKMLYDHKLIGDKKYARLIRSKAFTDDELAGFIARQLVETRQATKETADLLKRLCPKSRIVYAKAQNASIFRQKFDIPKSRTINDLHHAQDAYLNIVVGNIFDTKFTQDPRNFIKNTKDSRNYNLEKIYDYNVERNNYVAWIAPDGETNGTIANVKCNLSTKDFRVTRPSFYKKGALFNQNLSRKGSNLAPIKEHSPKSNPLKYGGYSGKNNSFFVVVAGKDNKGKDIVKLIPVNTLIYNKMLHCDYKAKQELLTSYVANNFAINNFRIVKDDIKMYSLVKIDGAYYYLVGGTDERIEVKNAMQLLLSKDSIKAVKILEKESKDQFANIKNYKDIDIKLGRTFNEVVSKYTNSVFGKSMLISDKYRKDIFKSVEKSILEFNHLDTIGKADNLLKFVTLMRPSGSAHSLKMVGLIERIRKSNVISNFNEFKLINQSVTGLFENEEDLLKL

SEQ ID NO: 505 - protein, 1395 aa, Lactobacillus jensenii; identical to SEQ ID NO: 118

SEQ ID NO: 506 - protein, 1382 aa, Lactobacillus mucosae
MDIGTNSIGWTAIDDHFSLLRVKGKNAIGVRTFKEGETAADRRGFRTARRRLSRRRWRLQFLDEFFAPYLAEVDPNFLARLKQSDISAKDPAKNQEYMGKLLFPDQEAASDGNGYPTLIQMRKAMPAEKAADFPVFNIYQLRYALMNEKRKFDLREIYLAVHHIVKYRGNFLNNTSVDKFKADQIDFNKSFETLNDLFRQVQPIAPFQIDLTKVDELGKLLLDTKQKKLDRQKAVAKLLPLIEDGTDKEIVKAHQQTAREISKLILGYKAKVGLILQNNLDQTLDMSTENSDDQLMQIAEELDDYQMELINQLSLLYSQIMLNEIVPNGETVSASMLNRYYKHRCQLKELKDYGAAQDKKTREQLDHLYAEYIGQIPKDSKFDFTKDLKKLMDKSDLGQKIKDEIEAGDYLPKQRTSANGVIPHQMHQQELDQIIENQKEYYPWLAEPNPVEKNIKNAKYKLDQLVSFRVPYYVGPMITLADQQKTSKASFAWAVRKKAGKITPWNFYDMIDREKSANNFIKRMTNKDTYLLSEDVLPASSLLYQKFTVLNELNNIRVNGRKLQPALKQAIYTDLFQKRKTVNLKTLTNFLAIHEPTLTKPKIEGLSNGRSFNSSLGTYIDMSKILGDSLDDLNYRDDIEKIIEWSTVFEDSEIYGVKLQEIQWLTNEQREKLVRKRYQGWGRLSKKLLTGITDENGQRIIDLMWDTSKNFMQIVHQPVFEEQIAELNQQLLQDADKAPLEVVDDILADAYTSPQNKKAIRQVVKVVADVVKAVGNAPASISIEFARNEDRNKELKNSRRHSIEKLYHETAEKLVKQTNLLEELGNVKDLNDRYYLYFTQAGRDMYDGTPINIDEISTHYEIDHILPQSFLKDNSLDNRVLVKKSENAAKSDRVPAKLYGAKMRAFWKQLKESQLISNRKYLNLTTDPEQVDKYQMQGFVHRQLVETRQIIKLAANIFGSLYPDSAVIETRAELTKQLREKFSLYKVRDVNDYHHAVDAYLTAFAGHYLYQRYPKLRPMFVYGDYAKIYADDLKRLRSVNLFHDLEKDQYNSGTAVNPETKEKIVDVDWLSDYVSKIQHFKYMLISKAVYTQHGQLYGATILPVAQVDKISAPIGIKDDKPVDIYGAYTNEVAAYMAIVRVNGKKPKYKVVSVPVRMLQRLKMAEQKGHDQYMQTLHDVLLRNFTSLKKNRKTGLKEAVVKDFDVLVPCVRYNQLVIDGDTKFTLGSATYQHNAKQLVLCNHSLETLANNFEYVRKHPDEADERMIMLYDDILDQVNHYFTLYDKNKFREKLNAGRDKYLKLPTFSQFENNKKTAIGKSEAIINILRGLHANAAITNLKCLGVSTPFGQLQSPSGIELSENAKLVYQSPTGLFSREVLLKDL

SEQ ID NO: 507 - protein, 1382 aa, Lactobacillus pentosus
MKKIVNYNLGLDIGTSSIGYAAIDDQGRPVRHQNKTVMGVRLFKEGKTAESTRIFRGTRRRLSHRHWRLGYLDRIFDNEIAKVDENFLPRLKASKRARSDEKRSFRGSLLFPETGDDAYYQKYPTIYHLRYALITQKKQFDIRLIYLALHHMIKYRGNFLDTTPVSAFNIHDIDLTDQFASLNDCYQLLDMDFEFQFDLNNIEQVQKLLLDETLSKTKRQAAVSKVLVMSTGNKAFDDQQNGIASEFIKALLGGPFDLSKILNLSVADVKSWKLHMTDKDVDDTLNSLVEELDENHKQIVNLLQMIYSQVMMLGLLNGQQSISASMIERYDDHAKHWAALKKLLPALGEQEQSTIIHAYTAYTGHSRTKQLSRAEFYTKVNSILKKHENIAEATGLIELIDRNEFMPKQRDAVNGVIPHQLHQRELQLIIQNQQKYYPFLAAKAYPDADETMIEQLLSFRVPYYAGPLVDRDFINESSDQEQAMQNTKFSWLKRREAGEITPWNFEQKVDVQETANRFIKRLTTKDTYLMTEDVLPKESLIYQRFEVLNELNAIRINDRRLTAENKQLAFQQLFMAGNTKNVSIKKFRNFVFDSLKFPEKVKITGFAGQHNFLAKLSTYHDFKKIFGERVDHTDLQPDFERIVEWCTIFEDRHIYREKLKEIQWLSQSEIDQLVLIRNHGWGRLSKRLLTGIRDSDGRTVMDQLWFGTDNFMRIISQSDFAAAIANENRTQLNQHGLEDVLDSAFMSPQNKKAIRQVLKVVDDIEQTLGCPPKKVMIEFTRSPDKKKQRTVTRLEKVQQAYKAVADQLAGQSIVSELDQYANTHSKLSDTYYLYFMQLGRDLYSGKPIDIDSPMLDDDHILPRAFMKDNSLDNRALTEKPINNTKAAKFPSKVFGQQKEVTDFWKLLRRCGLMSNIKEKHLYLDPDNVDKWTRRGFIHRQLVETSQVIKIVANILNDRYQQSQTEVLEVPARLGTELRECFGWYKVREVNDYHHVFDAYLAAFIGNYLYRRYPKLQPYFVYGNFAELNKAQLKNIKSFNFLYNITDNKRVVKDIETGQTLWDDQIRQQIQHIYEYKYMLTSHEAFTQHKELYGQTIYPRREFKPGTLKAIKQDQPQELYGGYKNLTAAYMCIVKIQARKRRAAEYRVVRVATESLSALQQAKRLGVQAYERCLRQELVRNNEILRTNADPNSAPREFEVLLDRVLCHQMIISDGQKYLLGSHAYKINCMQLVLSNNSMKILSTSIVKLKQMTNEPLVQVYREILDVVNKYFTLYDVNSFRENLNQFFDKFRTLPITNEYESSKSGKKLIHRGQLETLTLILRGLHANSDKVQYGDQSTLLGGFQTKDGIKLSKDSVIQYTSPAGLNVRTVKLRDLEQKEAQK

SEQ ID NO: 508 - protein, 1361 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDKEFYDDYATIYHLRDKLMTSNRKFDIREIYLAIHHIVKYRGNFLRTGPASQYGSASLHLATSFQKLNDLFAQSEETLNLKLVTDEALLQQIQQILVRTDLSRSEQQRQIWPLMAVLTGASAAEKKRQKNVVVELSKALVGLKAKMNVVTLTEVDAAVVKDWTFTMEESQDKLPEIEEQLSEVGQQIMDEVIQLYASVNLAQLIPAGKRFSQHMVEKYKHHEKNLELLKAYIHSQSDSKRGREIRATYDRYIDGVDSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDRKLAPQQKQRLYNQVFKQHQHVSVKNIQQNLMDAGEYRKTPQITGLADPKGFNSSLSTYHDFKKILLEAIADEHKRADIEKIILWSTTFEDSAIFKQKLEEVAWLTDAQRKQLSGLRYRGWGQLSHKLLTAFKDDKGRSIMDGLWETSDNFMQLRKQPAIETQIKEANQANLTDADIQDTINELYTSPQNKKAIREVMLVLDDIKNAMHGQTPSWIFVEAARGGGVAGRRTQSRSSQIVEAYKGTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPAASIVAVKANLTHQFRQTFNFPKLREVNDYHHAFDASLTAFIGMYLLKQYPKLERFFVYGKFAKQPINLTRFNIIRKLAVAEKPIANIETGEILWDKTADIKYFEKLYNYKRLLVTHEVRENYGAMFKQTLFKASYNKSKTLVPKKNHMETSVYGGYSNQETAYLAIVRIPFKSGFKFIVVGIPTRMVAKIKHYQSLGATLNQATHKVIEPKFTKISRKTKQTVISDYEVVLPKVYLDQVVRDQVKGQMYRFSLGSDKEYHNVQELYLPLSIQQAFVGHYDESDDQRSNDLVKVYDAALKQLQRYFPLHLSRNFDQVASQAHQSFEGLKNNVQTSDKQLGKKEVLNSLFVGLHANATRSNLSVLGMSKDFGRIKSNGITLTDQAEIIYQSPTGLFERKVALKDL

SEQ ID NO: 509 - protein, 1358 aa, Lactobacillus pentosus
MNEPYGVGLDIGTNSVGWTVVDMNGRVRKVKGKTALGARLFKEGATAEDRRGFRTTRRRLKRVKWRLRLLREFFDQPISKIDPNFFARRKYSDISPRDPNYNGLAKTLFNDRTDQEFYHDYPTIYHLRDKLMTSDRKFDIREIYLAIHHIVKYRGNFLRTGPASQYGSASLHLATSFQKLNDLFAQSEESLNFKLVTDEAQLQQIQQILVRTDLSRSEQQRQIWPLMVVLMGATAAEKKRQKDFAKELANALVGLKAKLNVVTLTNVDTTVVKDWTFTLEESQDKLPEIEEQLSEVGQQIMDEVIQLYASVNLAQLIPAGKRFSQHMVEKYNHHEKNLELLKAYIHSQSDSKRGREIRATYDRYIDGVKSKPVTQEMFYKDLMKYVEADATSNHLAAEIKDEIDSEQFMPKLRTKQNGSIPYQVQQYELDQIISHQKKYYPWLGEENPVAERRGKFPYKLDELVGFRVPYYVGPLITKEDQQATSGAGFAWMVRKADGPITPWNFDQKVDRIASATAFIQRMQTTDTYLIGEDVLPARSLIYQRFMVLNELNNMRVEDQKLAPRQKQRLYNQVFKQHQHVSVKNIQQNLMDAGEYRETPKITGLADPKGFNSSLSTYHDFKKILPEAIADEHKRADIEKIILWSTTFEDSAIFKQKLEEVAWLTDAQRKQLSGLRYRGWGQLSHKLLTAFKDDNGRSVMDGLWETSDNFMQLRKQPAIETQIKEANQANLTDADIQDTINELYTSPQNKKAIREVMLVLDDIKNAMHGQTPSWIFIEAARGGGVAGRRTQSRSKQIVEAYKSTAKEIVSEKVQHELNEKIKAKADFNTRLVLYFLQNGRDLYTNEAINIDRLSEYDIDHILPQSLVKDDSLDNRVLTSARINREKNDTFASEKFGRKMGAQWRELHRNGLMTQRKLKHLLMRPDEISKHATDFINRQLVETRQVIKLVEELISSEYPSASIVAVKANLTHQFRQTFNFPKLREVNDYHHAFDASLTAFIGMYLLKQYPKLERFFVYGKFAKQPINLTRFNVIRKLAVAEEPIANIETGEILWDKTADIKCFEKLYNYKRLLVTHEVRENYGAMFDQTIFKATDSRKRLIQKKKGFATETYGGYTGRTLAYLAIVKVVTNKDTQYQVVGIPTTMVTQIQQLEASGLTSKQAVTKAIGAMINENNKKLQSYEVLLPKVRFEQVVRDEVKGHIHRFALGTDTYYHNIQELYLPLTIQRAFLGKRNDTDAQTEQNLLTVFETTLAQVNRYFPLYEMNKFKQILNSAQEKFAALPTKNKTVKNKLVTGKDGVLNNLFIGLHANASLGDLKILGMKIGFGKLQVPGGLKLTDQAEIIYQSPTGLFERKVALKDL

SEQ ID NO: 510 - protein, 1358 aa, Lactobacillus plantarum
MKEPYGVGLDIGTNSVGWTVVDASGHVRKIKGQTGIGVRLFKEGAAAADRRGFRTTRRRLKRVKWRLRLLREFFDQPISKVDINFFARRKYSDVSPRDPNYNGLEKTLFNDRSDQDFYHDYPTIYHLREALMTQHRKFDVREIYLAIHHIVKYRGNFLRNDAATAYRSGTLDLQQHFETLNHLFSQADLELNLNLTTDVALLDSIKQTLVRTDISRSDRQKLIMPLLAVLTGATTAEKKRQKAVVTEFAKALVGNKTKIDVLTLTDIDATEAKDWAFSLEENQDKLPGIEDRFSEVGQQIIDEVIRLYASVNLAQLIPEGKRFSQSMVEKYKRHGEDLKLLKAYIRSQSDAKRGRAIRATYDQYIDGVKSKQVTQEAFQKALGKFVDADVDLNSWAAQIKQAIDSEQFMPKLRTKQNGAIPYQVQQNELDQIISNQKEYYPWLGEENPVIKRRGKFPYKLDELFGFRVPYYVGPLITKEMQAATANAGFAWMVRKADGPITPWNFDDKVDRVASATAFIQRMQTTDTYLIGEEVLPARSLIYQRFMVLNELNNIRVDDGQLTPRQKQRLYNQVFKKHKRVTAKNIQDNLVAAREFPTAPRITGLADPKVFNSSLSTYHDLKQVLPEAMSDVRKQADIEKIILWSTIFEDSTIFKQKLTEISWLTAAQLKQLGQLRYRGWGQLLRKLLTGLKDDNNRSIMDGLWETNANFMQLRSQPAIENQIKSANQANLTTADLQDTINELYTSPQNKKAIREVMVVLADIKDAMHGQTPNWIFVEAARGGGVAGRRTQSRSKQIVAAYQGTAQAIVRDQVQRELKEKIKNKANFNTRLVLYFLQNGRDLYTGDAINIDRLSEYDIDHILPQSLVKDDSLDNRVLTNARINREKNDTFASEKFGKKMGAKWKEMHRMGLMTKRKLDHLLMRPDEISKYATGFINRQLVETRQVIKLVEELINAEYPSTAIVSVKANLTHQFRQTFDFPKIREVNDYHHAFDAALTAFIGTYLLKRYPKLERFFVYGKFAKQPVNLTRFNVIRKLAKTDTPITDIDTGEVLWDKLTDIKYFETLYDYKRLLVTREVSENYGAMFDQTLLKASDNGKRLIRKKQSFDTAIYGGYTGKTLAYMAIVKVSTKKDVQYQVVGVPTTMVTQIEQLEQQGMTNKQAVTKVIEPLIAANNKKMLTYEVLLPKVRFEQVVRDRIKGQTHRFALGTDTYYHNIQELYLPLTLQRAFLGKQNESEVQLNQNLLTVFDATLAQVNRYFPLYEMNKFKKILNSARDQIELLEAKNQFVKNKLVLGKQGILTNMFIGLHANASYGDLKVLGVKIDFGKLQVPGGIKLTGDAEIIYQSPTGLFERKIALKDL

SEQ ID NO: 511 - protein, 1361 aa, Lactobacillus rhamnosus
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQEHYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 512 - protein, 1361 aa, Lactobacillus rhamnosus
MTKLNQPYGIGLDIGSNSIGFAVVDANSHLLRLKGETAIGARLFREGQSAAERRESRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPVQLQQRELDQIIANQSKYYDWLAKPNPVEKHRASKPYQLDELLTFRIPYYVGPLITPKEQAESRENVFAWMIRKDPSGNITPYNFDEKVDCPASANMFIQRMKNTDTYLIGEDVLPKRSLLYQKYEVLNELNNVSIDGRRLGADQKQRLIREVFERHSSVTIKQVAENLVAHGDFAKRPEIRGLADEKRFLSSLSTYHQLKKILHEAIDDPTKEHDIENIITWSTVFEDAAIFKTELAKISWLDSDTIKALSNIRYRGWGQFSRKLLDGLKLGNGHTVIQELMLSNHNLMQILTDETLKTTMAELNQDKLKADDIEDVINDAYTSPSNKKALRQVLRVVEDIKHAANGQDPSWLYIETADGPGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFASKMAATWRKWHEAGLISGRKLRNLMLRPDEIDKFAHGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIVAKDTGEIVWDKERDIQELDRIYNFKRMLITHEVYFETADLFKQTIYAAKDSKERGGSKQLIPKKQGYPTQVYGGYTRENTAYLAVVKTVEKKADVYRVVRIATSQVAALKEARAQSTVKERELLKKFLTTKFTKIGKNGKKAITPFDIVIPRVPREQLFHNKRYGFFMVNSDTLMHNYQELWMSRSDQQILSKLVKSAKTVENGQVGRLFENIVEQINKYFPLYDINQFRKKLDQSKDIFSKLPLEGNGTTSGKRETIQNILTGAGTGAKNGDLKNLGIKTPFGFLQVPSGIVLDDDTTLIYQSPTGMLNRIVRLSEL

SEQ ID NO: 513 - protein, 1352 aa, Lactobacillus ruminis
MNDNFDLMRVKGKKGIGVRLYNEGQSAAERRMHRTARRRYGRRKWRLRLLEDFFDEHMAEVDDTFFARLKDSNISPKDDKKYRKSLLFPKSKGVTYQDDGEFYKKYPTMYHLRYALMTEHRKFDLREIYLAFHHMVKYRGNFLYDTSVDSFEAKNLDIKGKFDEINDLLSSYTDFYVDNSNAALVESILLEKNTTRKDKSKKIAKLLHVEDKEKGKNKKAKDLATQISNAVLGLKCNFHLIFELQQKYSFDLCSEKTEENIAKLSEVLDENQKMLLMILKEVQDQVMLNAFVPSGMSLSEAMMQKYDDYGEQLKIYHELEHSVSDDSAAKLRGAYRDYNDNIIKRIDGDNKKDTFYKRVKNILTKISKEYVDQDVLESCGKLKKLIDENKLFIRQRTAANGVLPHQLHQIEMRKIIDNQKEYYPWLAEPNPNEKRRVYSKYKVEELIAFRIPYYVGPLVDPNNADKNKEARFSWMVRKKDGEITPWNFYDKVDWAESANNFIERMKSKDTYLLGEDVVPKESMLYQKYEVLNELNNLRINDSGLSDSFEDVKLKQAIYNDLFKKQKIVKITDLQNYLVQNHKYLVKPKISGLADENRFLSSLSTYSDLKTIFGDKVDDRTYFNDFEKMVEYSTVFEDGHDYNQKLDEYTWLTKEEKYKIGKKRYRGWGKLSKKLLTGLRDKNNHTIMDNLWETNRNFMQIQTADEFSKQIAEENERHLKGSVSDAINDMYTSPANKKAIRQVLRVVDDIQKAMGYAPSSISLEFAREDGPSVRTVSRANRMKSIYEKYASEVSEEVMKDLDGVIKDKKGLNDRLYLYFEQQGKDMYSGHPLDFDKVISGQEYDIDHILPQAVIKDDSLDNRVLTTKALNNDVKSKGVPCRMFNGMHSFWKNLYDKGFISRRKFNNLTTNPENIDKYKMKGFVNRQLVETRQIIKLVANVLNDKYQNDDVDIIEVRAELTHDVRKHFKFYKNRNVNDYHHAFDAYLTSFIGHYLFKKYPNLRPLFDYNDFMKVSDNVFKQLRGNNFLGEFLNKTGDIISTDGNFVLNKEEMINKLNKAYAFKKILVTKEVGQRTGAMFNETRYPAPNSRKAALKYRRMPKPDSLISVKDYKNTDIYGGYSGKNDAYMVIVDMGKQYMVVGVPVRYTEKLDKLRIKHSELYRDELRKVLSRDKTLLDSKGNVKRFDIVLDRVLYGQLIEDGNELFTLGSSKYKRNFRQLFLDKQCIEILDSSATPQPTDEELIWVYDQILDKVDKYFELYDINRQRETLRKGRAAFCSLPNISMKKDDVTKKKILNEILVALHANESESNCEKIGKKVFGRLQVPGGIKLSKEAKLIYQSPTGLFERVVYLKDL

SEQ ID NO: 514 - protein, 1339 aa, Lactobacillus salivarius
MERYHIGLDIGTSSIGWAVIGDDFKIKKKKGKNLIGTRLFNEGATAAERRGFRTQRRRLNRRKWRLKLLEEIFDPYMAEVDEYFFARLKSSNLSPKDSNKKYLGSLLFPDKSDSNFYDKYPTIYHLRRDLMEKDEKFDLREIYLAIHHIVKYRGNFLEKVPAKNYKNSGASIGFLLEEVNSLYKDIIGDESIAILNSEKFEDVEKIILDEETRNLDKQKSVGKLLVEDKKKKNIVTAFSKAIFGYKFNIEDLLLIENDEKNKLTFNDENIDDIFNELSHSLDDKQMDLLTKTREIYFKFKLNMIVPTGYTLSESMIEKYEMHKAHLKMYKEFINTLNTKDRKILKNAYSDYINTEKAKAANAQENFYKTVKKIIKDNNSDTAKKIIVLIDEGNFMPKQRTGENGVIPHQLHQIELDRIIENQAKYYPWLAEANPVEKNRKFAKYKLDELVTFRVPYYVGPLIDKTESNKNEKETKFAWMVRKAKGTITPWNFENLVDRTESANRFIKRMTSKDTYIIGEDVLPASSLLYEKFKVLNELNNIKVNEKKLDIEQKQDIYLNLFTTAKNVTKKSLATYLNCSADSISGLSDGEKFNSSLSSYIDLKAILGNIVDDCNKNEDLEKIIEYSTVFEDGNIYKEKLSEISWLTDEQIEKLSNIHFKGWGRLSKKLLTQITNENGERIIDALWNTSNNFMQIINDESIQAKLAEINGKYAGKSDLEDILSEAYTSPQNKKAIRQVMKVVEDIEKAMQCEPTSISIEFTRKKQKSRLTNTRYKKISDVYEKIADEVISEYELRKLQSELDSNANNMRDRYYLYFMQLGRDMYTGEKINIDELHQRYDIDHILPQSFIKDDSINNRVLTRKDVNNKEKSDKTAADLYAVEMSDFWRKLRKQGLITEQKYKNLLTKSDSIDKYAKKGFIKRQLVETSQVVKLVANILQDKYSDTKIIEVRAKLNSNLREEYKLIKNRAVNDYHHAIDGYLTTFIGQYLYKTYPKLRSYFVYNDFKKLDSNYLKHMKKFNFLWQLQDDKTIDIYDNVNNKFVLNVPEMKKYIQKIYNYKYMLVSKEVTTKNGAFYDQTKYNAKTVNLIPIKKNKPTNIYGGYKGKVSSYMMLVKIRKKKEVIYKFVGVPRLWTDELDRLKDTTERKILLNEIAKNSLSKTEQDFEVILDKVYYGQLIIDGNQKYTLGSSEYKYNAMQLHLSKHALEVLAKENVKDAEITDKDLVSVYEEILSVVNKYFELYDINKFRQKLNEGLEIFRKLPVYNVYESNKIKQVGKFEVLNRILMGLHANAMITDLKVLGIKTKLGQMQVNGGIKLSPDAKLIYQSPTGIFSRAVRVKDLG

SEQ ID NO: 515 - protein, 629 aa, Lactobacillus salivarius
MERYHIGLDIGTSSIGWAVTGDDFKIKRKKGKNLIGTRLFKEGNTAAERRGFRTQRRRLNRRKWRLKLLEEIFDPYMAEVDEYFFARLKDSNLSPKDSNKKYLGSLLFPDISDSNFYDKYPTIYHLRRDLMEKDEKFDLREIYLAIHHIVKYRGNFLENVPAKNYKNSGASIGFLLEEVNNLYKDIVGDENVTILNSEKFEDVEKIILDDGIRNLDKQKGVGKLLVEDKKNKNLVTAFSKAIFGYKFNIEDLLLVEGDEKSKLTFNDENIDDIFNELSHSLDDRRMDLLTKTREIYFKFKLNMIVPTGYTLSESMIEKYEIHKAHLKMYKEFINTLNSKDRKILKNAYTDYINNEKAKAANAQENFYKTVKKTIKDNDSDIVKKIIDLIDEGNFMPKQRTGENGVIPHQLHQIELDRIIENQAKYYPWLAEENPVEKNRKFAKYKLDELVTFRVPYYVGPLVDKTESNKNEKETKFAWMVRKSKGTITPWNFENLVDRTESANRFIKRMTSKDTYIIGEDVLPASSLLYEKFKVLNELNNIKVNEKKLDIEQKQNIYLKLFTTTKNVTKKNLATFLNCSIESISGLSDDKKFNSSLSSYIDLKVILGDIVDDYSKNEDLEKIIEYSTIF

SEQ ID NO: 516 - protein, 897 aa, Lactobacillus salivarius
  misc_feature (822)..(822): Xaa can be any naturally occurring amino acid
MLIESDEKNKLTFNDENIDDIFNELSHSLDDNQMDLLTKTREIYFKFKLNMIVPTGYTLSESMIEKYEMHKAHLKMYKEFINTLNAKDRKILKNAYSDYINNEKAKAANAQENFYKTIKKTIKDNNSDTAKKIIGLIDEGNFMPKQRTGENGVIPHQLHQIELDRIIENQAKYYPWLAEENPVEKNRKFAKYKLDELVTFRVPYYVGPLVDKTESNKNEKETKFAWMVRKAKGTITPWNFENLVDRTESANRFIKRMTSKDTYIIGEDVLPASSLLYEKFKVLNELNNIKVNKKKLDVEQKQHVYLDLFTTRKNVTKDNLATSLNCDVESITGLSDNEKFNSSLSSYIDLKAILGNAVDDCNKNKDLEKIIEYSTIFEDGNIYKEKLSEISWLTDEQIEKLSNIHFKGWGRLSKKLLTQITNENGERIIDALWNTSNNFIQIISDESIQAKLAEINGEYADKSNLEDILDEAYTSPQNKKAIRQVMKVVEDIEKAMKCKPTSIAIEFTRRKGKSKLTNTRYKKISETYEKITDELISEYELGKLQSKLDSKANNMRDIYYLYFMQLGRDMYTGEKINIDELHQYYDIDHIFPRSFIKDNSLNNRVLTRKEINNNEKADRTAADLYAVKMGDFWRKLRKQGLITEKKYKNLLTRTDSIDKYTKQSFIKRQLVETSQVVKMAANILQDKYSNTKIIEVRARLNSDLRKEYELIKNREVNDYHHAIDGYLTIFIGQYLYKTYPKLRSYFVYDDFKKLDSNYLKHMDKFNFIWKLEDKKAEDVYDNVNNEFILNVPKMKDYIQKIYNYKYMLISKEVTTESGAFYXZTKYNAKTINLIPIKKDKPTNIYGGYKGKVSSYMMLVKIQKKKEVIYKFVGVPRLWTDELDRLIDTDEKKALLKK

SEQ ID NO: 517 - protein, 1419 aa, Lactobacillus sp.
MAKPQNYTIGLDIGTNSVGWTVTDDQNNILRIKSKKAIGARLFEEGKVAAERRSFRTTRRRLSRRKWRIKLLEELFDEEISKVDPNFFARSHESWISPKDKRERYSAIVFPTPEEDKKFHNEYPTIYHLRDRLMKDDQKHDIREIYVAIHHIMKYRGNFLHDESIETYRSGMSSLGGGDERTILNTKILDDLNDAFADNLATQGISVNSASADQINEIVTSGHLNVDSQKAIAKLLLPTTLSSDDKKQDKKIKKLATDAAKNVASAWLGYKANFAAILNIQEVDKDKKKIYSFALQGADEEDKVETLESVLSQDQIEIVDRIIRIRHAIVLGEIIPVGMTLSEAMIEKYDQHAKDLKNLKTVIRNLKDRKNAVKLQAIYDLYVNNRHADTAKAMKLAGVKKRTELLEPEEFNKSIEKLLDDSPVSAEIKKRIAEKDFLPLQRSNSNGVIPNQLHQIELDEIIKKQSKYYPFLGETNEHASADVARKAPTKLDQLLTFRVPYYVGPLITKEEQEEQDGHSFAWMIRKNPKDHEKITPWNFDEKVDRMASATQFIKRMTTKDTYLLGEDVLPSSSLKYQLFTVLNELNNLRINHKKLTREEKEQVIEDLFKKYKTVKADKFKNYWQKGHAGLDVKIQGMADPEKFNSTMSTYIDLQKIFGDQLDDAQRQNDFEKIIEYSTIFEDRKILGEKLRADFVWLSEDQIKRLCRLRLQGWGRLSLKLLTRLTDADGQNVLERLLNSNDNFMQIVKDPVIKAKIEQKNQKLLRADWSENATESILDEAYTSPQNKKAIRQVMRVVHDIVKACDGNLPAKFAIEFARSQDDDPKRTVARADRLQKIYAQISDEVVSQGVKDQLSGMKSLKDRYYLYFMQGGRDAYTGKPLNIDRLSDYDIDHIMPQSFIKDDSLDNRVLVTRAVNNQKSDNVPVLLYGNHLVADLGITIREMWDRWQKSGMISKRKLANLLTDPATLSEYRAEGFINRQLVETSQVIKLTATILQSEFPDSKIIEVPAKYNSILRKQFDLYKSREVNDYHHAIDAYLSTIVGNYLYQVYPNLRRLFVYGEFKKFSHGEEESSHQAVRRVKSMNFLDDLLRGKHGDDIYCRVTGEVIFSRKDIISKLKQAYSFKQMLVTQEVFTKKSALFDQTVYPSPARDSKTRSGLIPRKQGMDTEIYGGYSGNKDAYFVLAQVVKSKGHTLQVVGVPIRALRALANCSNYSEQLLKIVKAQVLFNKKTGKAKKGISDVRILLDKIPYRQPVLDGSAFYMLGSSTYKYNLKQISLSQQSMKYILDYIDDPNFNKHEMTKIDQQNEKECLLSVYDEILDKMDKYLSLYDINGFRKKLHVGRDKFIKLEVEKQAEAIKNVLRGFHANSDMTKLSDLGLSTSLGFMQASDGIKLSDNAVFIYQSPTGLFERRVKVSDLLK

SEQ ID NO: 518 - protein, 1289 aa, Lactobacillus versmoldensis
MRRRYRRRRNRLNWLDELFADELAKIDPSFLLRMKNSWVSKKESTRKRDPYNLFIDEKYNDVDYFNQYPTIFHLRKELITEDKKVDIRLIYLAIHNIIKYRGNFTLENQNFDISQLSSNFSQQISDFFALFSDFGVIMPEDFDPDKISDILLNPNLSPSGKVSEAIATISPKTNVKAKIKIILLLLVGNNGDLKKLFDLETTEKIAVKLSSRHIDSELPIILSELNEQQENIITIANSIFGSIILKDFLGDETSISAAKVISFEDHKQDLQKLKTMWRETSNKEAVKAGKKAYEDYIGHEDSETFYKKIKKFLEKAQPVDLANKALAEIELENYLPKQRNRNNTVIPYQLNENELIAILDHQEKYYPFLKENRDKILSLLTFRIPYYVGPLQDSNNNRFSWMTRKASGAIRPWNFSEKVNVEQSSNDFIKRMRSTDTYLIGEPVLPKKSLIYQCYEVLSELNNTRVKDGSSNPKRLDVTIKQRIYNEIFKNQKSVSVKVLQNWLIKESYFKSPEISGLADKKKYLSSLSTYIDFKKIFGQRFVDDPVNSPQLEELAEWLTLFEDKKILLIKLQNSKYSYDQATINKLSTMRYQGTGKLSKKLLVDLKTTKKSIGKSGAESLSILDLMWSTKDNFMQIIHDADYTFEQQIKEFNYDTEDELTPLEKVANLHGSPALKRGLNQSIKVVADIVKFMGHDPEKIFIEFTRSDDFSKLTISRYRRIKKQYLEIAKAIKKIPAEFKDIKEYQTQLEENKGKLASERLMLYFLQCGHSLYSNKPIDLNMINSSKYHVDHILPQSYIKDDSLENKALVLASENENKIDNMLISHDIIATNLPRWQALKDQNLMGSKKFADLTRTTVTENQKKGFIQRQLVQTSQIVKNITLILNDLYKNTSCIETRATLSSEFRKAFSNFDETTYHYQFPEFVKNRDVNDFHHAQDAFLACVIGEYQLKKYPKDNLRLVYDQYSKFLDSLKKDTRKKNGRMPRYTQNGFIIGSMFNGKTYVDDNGEIIWDQKIKESIRKTFNYHQFNVVRQTIEQHGKLFNDTIQPHSDRYKLIPLKTNRDPAIYGGYNNDNNAYSVVLDVDGKKKINGIPIRIANQLKSDELDLSSWLENNIKHKKPMTILIDKVPKYQRIINEETGDLLITSANEVINNVQLFLPSMYTALISLLDSTKTEMYSKLLSNYEANILIDIYDYLLTKLKNNYPLYRKEWAKLAEHRDDFIESDLVTQASTLQQLIKFMHADPSNVNLKFGNFKGNRFGRKNGNIKLSKTDFIYESPTGLFKSIKHID

SEQ ID NO: 519 - protein, 1372 aa, Legionella pneumophila
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKNFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGGSSDKTLEQAIEKQNIQWEEKFQRIINASMNICPYKGASIGGQGEIDHIYPRSLSKKHFGVIFNSEANLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 520 - protein, 907 aa, Leptospira inadai
MAKSIEEIRSIQNEFVVEYSILLKKIKKGEIDKKNDVYKVYQNTIKSSERLEQVLKERLGFQNVSKSYFNNPYSIAQLYNLISVDRSGFSKVCRSCQEENHWRSTLIDTDRGPQAQASKQVSDTGRPFDGQLAMLLDRIAFEIVKLKRIEIERLLSNKNSSKIEVVEIPLLIEENSFNFRYELAELKKLSKKKKDQLKKSVEEFDTKLNSKQERIKAASRELCPYTGKKISKGEIDHILPRSWTQKQFGTALNAEANLIYASREGNQSKGNREYGLNDLDEKYLNIIFGTKEVDSIQRNISDTIDRLDIERGTTRIVFDRLAPNERDCLRHALFIKSLRPKVFELLSGQLKARVNGTQLYLAKRIRSLLLKNQDFITKSLIIKVPSFSFYEPRTVDLPYMRKELAEKFPNLGKQNPQPTGSHIIDAAMVMAYAVETDSGNLSFGSKDKSEGFDSESLSRFLPSNIQFLSIKSKDKTDSKYPYKKPLFKDGVFGERFLPILIAEKGLRVGYTLENSLEVNSENPEEFFNVLKPYLLFKRKPIESNYQTLVAFAQKDKRGYIVLPVNKPKALESISQRKSDPHTSILKNILYTVSRESIPSLIFDKNTLIPEIKSNKVNWGDKLEKKFRIKIEIKLYGKKIADGFIRYPGKTEWEKLLLTEPLKGLVKNKTLTPKWFDSLENLAGLDDHFKDTSNPEAKHKRKSNHYALPVPKGPSGGFRIRRNSFDGYKVYQLYSVDGNSFHAFKIENGWTGKTLLLDIYQNSGNLHSLDYDYENTDISQTALFSKFYKIEFSKEETQKINSKGIKSLYVAPGSSSRQYIRVIFDKQTFSKFIKFQSKFWEFDLITPLPKDKAKDLIESILKIFPEDLRPKKPRNDIHIQNISHDSVQVEYIADGKTQGFGQYFINQN

SEQ ID NO: 521 - protein, 418 aa, Leptospira inadai
MILKSPIAIDLGAKNTGIVYTTYQPNALPTEIHGATIISDNLKLSQVDRRAKRHQRRNYTRMKLARRLVYLIIRYHYRIPEQDLTPEVKTSLQSLLTRRGYTFQSIETEGNELGQAPWGEIEDYFPNVQDYEKSLPIQTVLYHFFSSENLELNKLVPSKEPETKEDKNILKYIREQKEAFESEQNNGARHRLKYFEEIKEDFPRKIKLMECLQKNKIEEKKFLNLIQNISNLQIKPLRAYFNDKDMKEKEIWEPRRLHTYIARWIRSWHIDPKNSSKRLIRQKLLSQLENGKLKIIRDTSIYSPSKDIISFLEEIDPKDTIPPYEDQNNRHPPRCQNLWLDGKILDRYFPGWEQSLWKLIRNEKNNPFEQLITKDFRTDDTISEGKSLSEQIQIYERSHSNIKLDVRAVILQRFLDRS

SEQ ID NO: 522 - protein, 125 aa, Leptospira inadai
MSAYDRSANLDPWSLRLQGKAKKEIKTTESLSKTDLQKASDAYEKIKEILSESDTDQFIKLANRYYLEVADIKKGMWLPTAPERKHKEIPKSIAHEENQDISLFHKCNTKTGSKKRISQVSLEMF

SEQ ID NO: 523 - protein, 1355 aa, Leuconostoc gelidum
MTYSIGLDIGTGSVGWAVIGDDYRLKRAKGKNLIGVRLFDSATTAAERRGYRTTRRRLSRRHWRLRLLNDIFASDLAEQDENFLPRLKYSWVNPDDEQNPQLNSDVANGALFGSSETDKAFHKNYPTIYHLRHELMTDTAKHDLREVYLAIHHIVKYRGNFLNTADKINAENSFNVDLFIAALDEYNEFLETPITSIKDAQLFSDKLTDINARNKSVRVENAMSETYDDKSKIFKAILTALVGNTANFQTIFDLSDLEKDEAKNFKFKLDLEDVETKLDVVRAKLSDEQNAFLEAVLIAYDGITLKMILGDYKSISQSMIESYKSHQRDWKYIKNNVRLNEQKIEPDKNSVKFFKLDPKKLIYPSNLAYLQVISSNEDEHRKGLDYFKTAIQDADILQRIENDTFLPRQRTKRNGVLPYQLHLAELEQIIKKQSKYYPFLANIYTQDNKTENKLIGLLKFRVPYYVGPLVEAEKVTGDGKNHWLIKKELQENTPITPFNFDDVVDKDKSGEQFIKRITGTDSYLIGEPTLPENSLLYQKYNVLQELNNVRNERHQRLPIKVKQDIFEHVFKIDKNVNAKKVMAYLKLNGYGDFQIAGLSDTRTGKFNSNLSSYNYFVDLLGREKTEKIREDRLEEIIEIQTVFEDKILVAKRLSNLDFLTPQEKSKLSAKHYTGWGRLSQKLLTTQFIKTALSEAGDIIPQSHSIIDLLYYTDKNLMEILNDKTFNVRNWLTEQNKGTESGNSLYDQIDALAGPKDIKRGITQVFSIIDDIKKAMGSNPETVYLEFARETQTSRLTNSRLNRVQEIYNSPELKTEFAYLAKKLEAETKESIHDDRLYLYYLQEGRDMYTGKEIPFDQISSNYDIDHIIPQAFTKDDSLDNRVLVNRATNARKSNSPTFTNDIIDNRKSWWQSLVKRGLMSKEKFERLTDKRKTFSENQTNHFIARQLVETRQIIKNVADLIKNNYDGTQAVAIRASLTGEMRRYLDWPKNRDMNDYHHAHDALMMATVGKYVDRRGFFDNGSVSDGAGNAYNLYTKDWLVAARVGTRNDSQRVNPYGFIVGSMNSKAVRQQVNKETGEIVWGNENLDYLRHVLSYKKILVTRRLSGSSGRLYAETLFSPNPKAKLIAQKANRSVALYGGFTKAESAYTALVEFNKKGDRSYKLIKVPMAIANRVNDKQITVTAYIASLNLRDFSRVVLEHLPLGTLIRESDGSEFYAASSEYKHNAKELWAPKEILRSSKKLDKATADNLIDIFDFLTNDKTISNFKFYEKDLLHLKNVRDKFVEASDEIKIKVLSDVIYELHNDAGWRDPFKHIQEKPAWTMLQVKGGIKLSEKAAIVYQSPTGLFETITIVGE

SEQ ID NO: 524 - protein, 883 aa, Leuconostoc pseudomesenteroides
MIGVRLFEGADTAAERRGYRTTRRRLSRRRWRLRLLNDIFASELSKIDENFLPRLKYSWVNKNDTDNVHFGVGVFDNSEQEKAFYQDYPTIYHLRQKLMTDNRQHDLREVYLAIHHIVKYRGHFLNSGEISANSSFDAQKFLELLREFDNTFYPDAVKFLNLDQLDLPDKISSEISDSKISKSERVDRVLQHVQLANSGAKKILKAILNAVVGNSVDSVAMFSLSDLDKEEKKKINHPVTDSKPFKYSDKEVEAKLDELSNLLQDEQKIEFLSLLKLSFDGLTLKMLLGNAKSVSEAMVERYKVHKDDLKFIKENILNSFSKDKKKEFDKYYEAHLAEKDVDNVDKYFKKIIDDSIISKDKKIELLQKIDDHDFLPSQRSKINGAIPHQLHRNELDKIISQQSKYYPFLADSYTQNGKTETKLAGLVNFRVPYYVGPLVSKENADRNNPDGGQNHWVEFKENTSLSNLTPWNFNEIVDKDKSAAKFIERLTGMDTYLIGEPTLPQNSLLYQKYNVLQELNNIRVDNHKLDVKIKQDVFEHLFKTQNSVSAKDVKNYLIANGYAAPSIQITGLSDTNEKTFNSKLSSYNYLVDKLGRTFVESVKSDVLEKIIELQTVFEDKTVLLRQLSMISELTLAQANQLAEKHWTGWGRLSRKLLSSKVVDVNKITNSTFYPATSRQTIIDTLYHTQLNLMEIINNAEDLYGVRQWISEQNKSDSSDTNDVYDQIQELAGDKKIKRGITQSFRILDDIVKAMGGEPERVYLEFARENQQSGVSFSRKNLLSKLYENDSLKQTFKELKSQLESETKENLQNDRLYLYYLQQGRDMYSNDELNIDQLSSYDIDHIIPQAYTKDNSFDNRVLVSSKANRLKRMLLWYPVKLSKK

SEQ ID NO: 525 - protein, 468 aa, Leuconostoc pseudomesenteroides
MKDQGFISKRKFENLTRRGDFSEQQKERFIARALVETRQIIVNVSSLIDSHFNHTKAVAVKSNMTTDMRHYTKVPKNRDINDYHHAHDALFVATVGQYIENKGFMKAGKLSDSVGNEYNRYTKKWIETARKNTNYGRVNPFGFVVGSMQTATRGKLDYETGELKVVKNNYWSKDDLDYLLKVVSYKKILVTTKLQDNKGAMYDANLISAKGSGKKKAQLQISKSKNIDLYGGFNKLQNEYSVLILNHDEYRWLSIPMYARNSSEQYLHDKYPDAKVILNHILVGQPILLSNSSDPQKSKFASLRIATGGDYHNNFEFVPSVDVKKILDNIYLNHSVTDDEYKKVFESLLATLHDKFVFGIHQVMYNKIFDNKYLFDKMPDEAKRNVINSLLKFMNISKNQLGAVGKIGGKVNGVLYGFKTETEKGTSAGQLISNGKMQPHDIFIFQSPTGIFERRVTVAELANVIKDE

SEQ ID NO: 526 - protein, 1103 aa, Listeria innocua
LKLYPGEKSTGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKTTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELKNNRLYLYYLQNGKDMYTGQDLDIHNLSNYDIDHIVPQSFITDNSIDNLVLTSSAGNREKGNDVPPLEIVQKRKVFWEKLYQGNLMSKRKFDYLTKAERGGLTEADKARFIHRQLVETRQITKNVANILHQRFNYGKDDHGNTMKQVRIVTLKSALVSQFRKQFQLYKVRGVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLIPRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHAANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 527 - protein, 1337 aa, Listeria innocua
MKNMKKPYTIGLDIGTNSVGWAVLTDQYDLVKRKMKIAGDSEKKQIKKNFWGVRLFDEGQTAADRRMARTARRRIERRRNRISYLQGIFAEEMSKTDANFFCRLSDSFYVDNEKRNSRHPFFATIEEEVEYHKNYPTIYHLREELVNSSEKADLRLVYLALAHIIKYRGNFLIEGALDTQNTSVDGIYKQFIQTYNQVFASGIEDGSLKKLEDNKDVAKILVEKVTRKEKLERILKLYPGEKSAGMFAQFISLIVGSKGNFQKPFDLIEKSDIECAKDSYEEDLESLLALIGDEYAELFVAAKNAYSAVVLSSIITVAETETNAKLSASMIERFDTHEEDLGELKAFIKLHLPKHYEEIFSNTEKHGYAGYIDGKTKQADFYKYMKMTLENIEGADYFIAKIEKENFLRKQRTFDNGAIPHQLHLEELEAILHQQAKYYPFLKENYDKIKSLVTFRIPYFVGPLANGQSEFAWLTRKADGEIRPWNIEEKVDFGKSAVDFIEKMTNKDTYLPKENVLPKHSLCYQKYLVYNELTKVRYINDQGKTSYFSGQEKEQIFNDLFKQKRKVKKKDLELFLRNMSHVESPTIEGLEDSFNSSYSTYHDLLKVGIKQEILDNPVNTEMLENIVKILTVFEDKRMIKEQLQQFSDVLDGVVLKKLERRHYTGWGRLSAKLLMGIRDKQSHLTILDYLMNDDGLNRNLMQLINDSNLSFKSIIEKEQVTTADKDIQSIVADLAGSPAIKKGILQSLKIVDELVSVMGYPPQTIVVEMARENQTTGKGKNNSRPRYKSLEKAIKEFGSQILKEHPTDNQELRNNRLYLYYLQNGKDMYTGQDLDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNYEKDDHGNTMKQVRIVTLKSALVSQFRKQFQLYKVRDVNDYHHAHDAYLNGVVANTLLKVYPQLEPEFVYGDYHQFDWFKANKATAKKQFYTNIMLFFAQKDRIIDENGEILWDKKYLDTVKKVMSYRQMNIVKKTEIQKGEFSKATIKPKGNSSKLISRKTNWDPMKYGGLDSPNMAYAVVIEYAKGKNKLVFEKKIIRVTIMERKAFEKDEKAFLEEQGYRQPKVLAKLPKYTLYECEEGRRRMLASANEAQKGNQQVLPNHLVTLLHHVANCEVSDGKSLDYIESNREMFAELLAHVSEFAKRYTLAEANLNKINQLFEQNKEGDIKAIAQSFVDLMAFNAMGAPASFKFFETTIERKRYNNLKELLNSTIIYQSITGLYESRKRLDD

SEQ ID NO: 528 - protein, 953 aa, Listeria ivanovii
MKKMLANIDGADYFIDQIEEENFLRKQRTFDNGTIPHQLHLEELEAILHQQAKYYPFLRKDYEKIRSLVTFRIPYFIGPLANGQSDFAWLTRKADGEIRPWNIEEKVDFGKSAIDFIEKMTNKDTYLPKENVLPKHSLCYQKYMVYNELTKIRYIDDQGKTHHFSGQEKQQIFNGLFKQQRKVKKKDLERFLYTINHIESPTIEGVEDAFNSSFATYHDLQKGGVTQEILDNPLNADMLEEIVKILTVFEDKRMIKEQLQSFSDVLDGTILKKLERRHYTGWGRLSAKLLTGIRDKHSHLTILDYLMNDDGLNRNLMQLINDSNLSFKSIIEKEQVSTADKGIQSIVAELAGSPAIKKGILQSLKIVDELVGIMGYPPQTIVVEMARENQTTGKGKNNSKPRFISLEKAIKEFGSQILKEHPTDNQCLKNDRLYLYYLQNGKDMYTGKELDIHNLSNYDIDHIIPQSFITDNSIDNRVLVSSTANREKGDNVPLLEVVRKRKAFWEKLYQAKLMSKRKFDYLTKAERGGLTEADKANFIQRQLVETRQITKNVANILYQRFNCKQDENGNEVEQVRIVTLKSTLVSQFRKQFQLYKVREVNDYHHAHDAYLNGVVANTLLKVYPQLEPEFVYGDYHQFDWFKANKATAKKQFYTNIMRFFAKENQIIDKNGEILWDNRYLDTIKKVLSYRQMNIVKKTEIQKGEFSNATVNPKGNSSKLISRKADWNPIKYGGFDGSNMAYSIVIEYEKRKKKTVIKKELIQINIMERVAFEKDQKAFLEEKGYYSPKVLTKIPKYTLYECENGRRRMLGSANEAQKGNQMVLPNHLMTLLYHAKNCEANDGESLAYIEMHREMFAELLAYISEFAKRYTLANDRLEKINMFFEQNKKGDIKVIAKSFDKLKVFNAFGAPRDFEFFETTIKRKRYYNIKELLNATIIYQSITGLYEARKRLED

SEQ ID NO: 529 - protein, 232 aa, Listeria ivanovii
MMSKLILGLDIGISSVGWGVLDESTNEVVDAGVRLFEEATRNGNEDRRGFRSARRLKRRRQHRLERAKGLIENNGFSCTDINKFNPYQARYNAIFGEVTKDELAAALFHLVKRRGTTIDAPEEEVKDVENELSTKMQLEKNAKKLATKYDYICEIQLEKLKENKVVRDHENRFRTEDYVKEARAILENQQEYYPEVTNEFIESYMALIETRRMYYDGPGSEKSPTPYGQYFI

SEQ ID NO: 530 - protein, 300 aa, Listeria monocytogenes
DDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHD

SEQ ID NO: 531 - protein, 782 aa, Listeria monocytogenes
  misc_feature (722)..(722): Xaa can be any naturally occurring amino acid
IFNDLFKQKRKVKKKDLELFLRNINQIESPTIEGLEDSFNASYATYHDLLKVGMKQEILDNPLNTEMLEDIVKILTVFEDKRMIKEQLQQFSDVLDGVVLKKLERRHYTGWGRLSAKLLVGIRDKQSHLTILEYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELKNNRLYLYYLQNGKDIYTGQELDIHNLSNYDIDHIVPQSFITDNSIDNLVLTSSAGNREKGDDVPPLEIVRKRKVFWEKLYQGNLMSKRKFDYLTKAERGGLTEADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKIVIEKKLIQINIMERKMFEKDEEAFLEEKGYRHPKVLTKLPKYTLYECEKGRRRMLASANEAQKGNQLVLSNHLVSLLYHAKNCEASDGKSLKYTEAHRETFSELLAQVSEFATRYTLADANLSKINNLFEQNKEGDIKXIAQSFVDLMVFNAMGAPASFKFFEATIDRKRYTNLKELLSSTIIYQSITGLYESRKRLDD

SEQ ID NO: 532 - protein, 1334 aa, Listeria monocytogenes; identical to SEQ ID NO: 114

SEQ ID NO: 533 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPMKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 534 - protein, 1334 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGNSSKLIPRKENWDPVKYGGLDSPNMAYAVIIEHAKGKKKIVIEKKLIQINIMERKMFEKDEEAFLEEKGYHQPKVLTKLPKYTLYECEKGRRRMLSSANEAQKGNQLVLSNHLVSLLYHAKNCEASDGKSLKYIEAHRETFSELLAQVSEFATKYTLADANLSKINNLFEQNKEGDIKAIAQSFVDLMAFNAMGAPASFKFFEATIDRKRYTNLKELLSSTIIYQSITGLYESRKRLDD

SEQ ID NO: 535 - protein, 1099 aa, Listeria monocytogenes
MKNPYTIGLDIGTNSVGWAVLTDQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDEVYKQFIQTYNQVFMSNIEEGALAKVEENTEVASILAGKFTRREKFERILRLYPGEKSTGMFAQFISLIVGNKGNFQKVFNLVEKTDIECAKDSYEEDLEALLAIIGDEYAELFVAAKNTYNAVVLSSIITVTATETNAKLSASMIERFDAHEKELGELKAFIKLHLPKQYQEIFNNAEIDGYAGYIDGKTKQVDFYKYLKTTLENVEGADYFITKIEEENFLRKQRTFDNGVIPHQLHLEELEAILHQQAKYYPFLREGYDKIKSLVTFRIPYFVGPLANGQSEFAWLTRKDDGEIRPWNIEEKVDFGKSAVDFIEKMTNKDTYLPKENVLPKHSLCYQKYMVYNELTKIRYIDDQGKTNYFSGREKQQIFNDLFKQKRKVKKKDLELFLRNINHIESPTIEGLEDSFNASYATYHDLLKVGLKQEILDNPLNTEILEDIVKILTVFEDKRMIKEQLEQFSDVLDGVVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKDFGSQILKEHPTDNQELKNNRLYLYYLQNGKDIYTGQELDIHNLSNYDIDHIVPQSFITDNSIDNLVLTSSAGNREKGGDVPPLEIVRKRKVFWEKLYQGNLMSKRKFDYLTKAERGGLTEADKARFIHRQLVETRQITKNVANILHQRFNKETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQINIVKKTEIQKGEFSKATIKPKGIPAN

SEQ ID NO: 536 - protein, 1334 aa, Listeria monocytogenes
MKNPYTIGLDIGTNSVGWAVLTDQYDLVKRKMKVAGNSDKKQIKKNFWGVRLFDEGETAADRRMNRTARRRIERRRNRISYLQEIFALEMANIDANFFCRLNDSFYVDSEKRNSRHPFFATIEEEVAYHKNYRTIYHLREELVNSSEKADLRLVYLALAHIIKYRGNFLIEGALDTKNTSVDGVYKQFIQTYNQVFISNIEEGTLAKMEENTTVADILAGKFTRKEKLERILQLYPGEKSTGMFAQFISLIVGSKGNFQKVFDLVEKTDIECAKDSYEEDLEALLAIIGDEYAELFVAAKNTYNAVVLSSIITVTDTETNAKLSASMIERFDAHEKDLSELKAFIKLHLPKQYEEIFSNVAIDGYAGYIDGKTKQVDFYKYLKTLLENIEGADYFIAKIEEENFLRKQRTFDNGAIPHQLHLEELEAILHQQAKYYPFLKEAYDKIKSLVTFRIPYFVGPLANGQSDFAWLTRKADGEIRPWNIEEKVDFGKSAVDFIEKMTNKDTYLPKENVLPKHSLYYQKYMVYNELTKVRYIDDQGKTNYFSGQEKQQIFNDYFKQKRKVSKKDLEQFLRNMSHIESPTIEGLEDSFNSSYATYHDLLKVGIKQEVLENPLNTEMLEDIVKILTVFEDKRMIKEQLQQFSDVLDGAVLKKLERRHYTGWGRLSAKLLVGIRDKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTVKGKNNSRPRYKSLEKAIKEFGSQILKEHPTDNQELRNNRLYLYYLQNGKDMYTGQELDIHNLSNYDIDHIVPQSFITDNSIDNLVLTSSAGNREKGDDVPPLEIVRKRKVFWEKLFQGNLMSKRKFDYLTKAERGGLTEADKATFIHRQLVETRQITKNVANILHQRFNNETDNHGNNMEQVRIVMLKSALVSQFRKQFQLYKVREVNDYHHAHDAYLNGVVANTLLKVYPQLEPEFVYGEYHQFDWFKANKATAKKQFYTNIMLFFAQKERIIDENGEILWDKKYLETIKKVLDYRQMNIVKKTEIQKGEFSKATIKPKGNSSKLIPRKENWDPMKYGGLDSPNMAYAVIIEHAKGKKKVVFEKKIIRITIMERKAFEKDEKSFLEKQGYRQPKVLTKLPKYTLYECENGRRRMLASANEAQKGNQQVLKGQLITLLHHAKNCEASDGKSLDYIESNREMFGELLAHVSEFAKRYTLADANLSKINQLFEQNKDNDIKVIAQSFVNLMAFNAMGAPASFKFFEATIERKRYTNLKELLSATIIYQSITGLYEARKRLDG

SEQ ID NO: 537 - protein, 1334 aa, Listeria monocytogenes
MKNPYTIGLDIGTNSVGWAVLTNQYDLVKRKMKVAGNSDKKQIKKNFWGVRLFDDGQTAVDRRMNRTARRRIERRRNRISYLQEIFAVEMANIDANFFCRLNDSFYVDSEKRNSRHPFFATIEEEVAYHKNYRTIYHLREELVNSSEKADLRLVYLALAHIIKYRGNFLIEGALDTKNTSVDGVYEQFIQTYNQVFMSNIEEGTLAKVEENIEVANILAGKFTRREKFERILQLYPGEKSTGMFAQFISLIVGSKGNFQKVFDLIEKTDIECAKDSYEEDLEALLAIIGDEYAELFVAAKNTYNAVVLSSIITVTATETNAKLSASMIERFDAHEKDLGELKAFIKLHLPKQYQEIFNNAAIDGYAGYIDGKTKQVDFYKYLKTILENIEGADYFIAKIEEENFLRKQRTFDNGAIPHQLHLEELEAIIHQQAKYYPFLREDYEKIKSLVTFRIPYFVGPLAKGQSEFAWLTRKADGEIRPWNIEEKVDFGKSAVDFIEKMTNKDTYLPKENVLPKHSLCYQKYMVYNELTKVRYIDDQGKTNYFSGQEKQQIFNDLFKQKRKVKKKDLELFLRNINHIESPTIEGLEDSFNASYATYHDLLKVGMKQEILDNPLNTEMLEDIVKILTVFEDKPMIKEQLQQFSDVLDGGVLKKLERRHYTGWGRLSAKLLVGIREKQSHLTILDYLMNDDGLNRNLMQLINDSNLSFKSIIEKEQVSTTDKDLQSIVADLAGSPAIKKGILQSLKIVDELVSIMGYPPQTIVVEMARENQTTGKGKNNSKPRYKSLEKAIKEFGSKILKEHPTDNQELKNNRLYLYYLQNGKDMYTGQELDIHNLSNYDIDHIVPQSFITDNSIDNLVLTSSAGNREKGGDVPPLEIVRKRKVFWEKLYQGNLMSKRKFDYLTKAERGGLTDADKARFIHRQLVETRQITKNVANILHQRFNNETDNHGNTMEQVRIVTLKSALVSQFRKQFQLYKVREVNDYHHAHDAYLNGVVANTLLKVYPQLEPEFVYGEYHQFDWFKANKATAKKQFYTNIMLFFGQKERIIDENGEILWDKKYLETIKKVLDYRQMNIVKKTEIQKGEFSKATIKPKGNSSKLIPRKENWDPMKYGGLDSPNMAYAVIIEHAKGKKKLIFEKKIIRITIMERKMFEKDEEAFLEEKGYRHPKVLTKLPKYTLYECEKGRRRMLASANEAQKGNQLVLSNHLVSLLYHAKNCEASDGKSLKYIEAHRETFSELLAQVSEFATRYTLADANLSKINNLFEQNKEGDIQAIAQSFVDLMAFNAMGAPASFKFFEATIDRKRYTNLKELLSSTIIYQSITGLYESRKRLDD

SEQ ID NO: 538 - protein, 874 aa, Listeria seeligeri; identical to SEQ ID NO: 180

SEQ ID NO: 539 - protein, 1087 aa, Listeriaceae bacterium
MKKLVLGLDIGVASVGWGIIDAENGDVVDTGVRLFSSRDASENESRRTSRQSRRLSRRKKHRRERIKQLLLAHDMDICDIVNENPYELRVKGLNEKLEVSEIYVALTHLAKRRGVSYLDDVVEEGGTIKSEHLNKNMEEIKSGKMPCEIQLERFEKYGQVRGMIEINQDTEESSFLVNIFRTSDYIKEAKTILATQQKFHKQITNEFIDEYIHIMASKRDYFIGPGNEKSRTDYGVYRTNGDTWDNLFEILIGKCSVFPEETRAARSSYVAQEFNLLNDLNNLKISNLESGKLSASQKHDIVEKVKNSKKFGTKDLLKYIASVCECKIEDIGGCRVDKNRKPIMHTFENYRKVHNALNEAGVDLRLSETDYDELMKIMTLNSETLEIKKQCKEKLPQLTEDYLNVCLVLNKKGAFSGWHALSLKAMKLMMPELYGTSKNQMQIIHTMQLGKAYLKPLNQQKYLNSEAILEEIYNPIAARSIRQTIKVTNAILKKYGHLDSVIIEMPRDYQTSEDERKMIEKMQKENEKEKKAALKRAREEYPFPDEAFRNHKELATKLRLWYQQDQFCVYSGRKISVVDLVRNPNQFEIDHIIPQSVSLDDSLNNKVLCFSEENQKKGQQTPFYYHKGKSGNWTYEQYKLFVEKLFDKKKISNKKRELLLFEEDINKWDVRRGFIARNLVDTRYASRVILNSYQQYFGNHEMGTKVKVVRGKFTSQLRKKWRIFKDRNESHSHHAIDALIVAATANLRLWKKNTLGVSDEGKVYDKETGEILPFEKLTESEYNEMMNKEPYLNFKTKLQNIETKVKYSYRVSKKVNRKISDATIYSTRERDGIDYIVGKIKNIYDVKTYKDQFLKRYKKNKEQFLMYQHDPQTFAILENIMATYQDAENPFLAYKKEYGVIRKYSKKGGGSPVTSLKFIDKVLGQKIDLTAKNQAALPKNKKVVLQSITPYRADVYYDEIDKRYHLIGVKYSLFSFSKQGYVINPIAYQKLLEKEQIHSEMKFCFSLYREDIIEFGEDPDSLTRYRFWSKNESGKNKIEVKPIEKPNFEKQTVLTITKKIKILNKYQTDVLGNSFKAQEEKDPRNIE

SEQ ID NO: 540 - protein, 1345 aa, Marinilabilia sp.
MKKILGLDLGTTSIGWAFIKEPEKDVVGSEIVDMGVRIVALSSDEENDFAKGNTISINADRTLKRGARRNLQRFKLRRDALLEIFKEMKLIPSNFKYAEDGPSSTFSTLKLRDKAAKEKIELDDLVKVLLQINKKRGYRSSRKAKSEEDDGSAIDSMGIAKELYENDLTPGQWVFEALQKGRKNVPDFYRSDLQEEFKKIVNYQSEFYPDVLNSSFVEDWMGKASTPTKQYFNKKGVHLAENKGKREERRLQEYNWRAVAVNSKIDLSEIALILSQINSQISNSSGYLGAISDRSKELYFKNQTVGQYLYQQIKINPHTRLKGQVFYRQDYLDEFEKIWSVQSGFHPQLNDALKKEIRDITIFFQRRLKSQKHLISNCEFEDYHKVVPKSHPIFQEFRIWQNLNNLTLIKKDNLNEKSELALEDKIALANELAFKREQSVKDALNILGLKSSEWEFNFTKIEGNRTNHAFFEAFAKIIEIEDGEPLDLGNLKADDILDQFSEAFLRIGIDPGLLQVNNDIEGPNYEKQPYIQFWHLLYSSEDDQKLKQNLIKKFGFKPDHAKILASISLQDDHASLSSRAIKKILPHLQSGLIYDKACTYAGYNHSSSFTKEENEKRELSSELDLLKKNSLRNPVVEKILNQMINVVNAILKDPNLGKPDEIRVEMARELKANAEQRKNMTSNIASATRDHEKYREILKKEFGLKRVTKNDLLRYKLWLETDGISLYTGKPIEASKLFSKEYDIEHIIPKTRLFDDSFSNKTICERQLNIDKANVTAFSFLQNKLSGDEFEQYQSRVKSLFGKLSKAKIQKLLMANDKIPEDFIARQLQETRYISKKAKEILFEITRRVSVTTGTITDKLREDWGLVEIMKELNWEKYDKLGLTYTIEGKHGERLNKIKDWSKRNDHRHHAMDALTVALTKPAYIQYLNNLNAKELNGKKSTEIFAIEQKYLKRENGKLCFIPPVENIRTEAKKHLSKVLISYKAKNKVVTINKNRTNKKAGFNEQIALTPRGQLHKETVYGKAFHYSTKFEKIGASFDVQKINAVAKKEEREALLKRLAENGDDPKKAFTGKNSLSKMPIYLDLKRNIKLPEKVKTVVLEQNYTIRKNIDPDLKLDKVIDVGVKRILENRLKEFGGNAKLALSNLDENPIWLNKEKGITIKRVKISGVSNVESLHVKKDHFGEPILDQVGNEIPVDFVSTGNNHHVAIYEDEKGNLQEEVVSFFEAVVRQNQGLPIINKNHSLGWKFLFTLKQNEYFVFPSDDFDPTDVDLMDEENYHLISPNLFRVQKFTTKDYFFRHHLETTVEDKSELKGVSFKRLGLPGLNCIKKIRINHLGKIIQVGEY

SEQ ID NO: 541 - protein, 1091 aa, Mobiluncus mulieris
MDSRKYRVGIDVGTNSVGFAAVEEDDSGSPTRFLNTMVVIHDSGVDSEQKKYAITRLASAGTARRTRRLYRTRRQRLRELDDFISNELGYPLVNLENFADPYEPWKVRADLATTKLPNDELPEAMSIALRHMARHRGWRSPYQRVEALHLHAEISKEFAALKERVVEKTGDVFSDDATPAEVLVDLMGRQKVRGADGVLSGKLRQSDNANELRKIASVQGIDDETLNRIIDRVFSSKSPKGKASERVGMDALPGQGSKPRALKAMPSFQKFRVVSVICNLRIKDSGGDARPLSMEEKEKLIDYLMSSTTDDHVTWTDVADLLHVKRSQLQGTAKEGFDGERPYTRPPVNSTWSKIKDSKIKSLVALWKTGDVDVQSAIVEALSNASVLEDSRPGADIVVAYLESLDDKELESLDKVGLPAGRASYSEDSLERLTERMLRDDCDLFEARKREFNVADDWKPPADPIYAPVGNPGVDRVLKIVNRLLMAAEREWGAPTQINIEHVRSGFSSELMQREFERENERRRAQNEEAVKAILTEKGGNSRVSKYDITRYYAVKRQHCQCLYCGTPITFSDCELDHIVPRKGVGSTNTRVNLAAACRSCNRDKSNLPFAVWAGKASNFDVSIDDAVSRVKQWQRSQNEGVREFRAFQNEVISRLLKTTEDPEIDSRSLESVAWMARELHHRVEYYFQSKGAQTQVSVYRGAVTAQARKSSGLEDKVKMIGGGGKTRLDRRHHAMDAATIALMTPGISTTLSEKNNLRDAQKFTGQSETWKDYCGRTETARKHFAVWKSNMERLTDLFNDKLENDAIPVVQPLRLRLSNSKAHDDGIGKLDSKKLGSVWSLADIDRAATPQIWTALTRCDDFDPTKGLPENANRVIRAQGVKYESEDNIPVFPSNVAAIAVRDGYAEIGSTIHHARIYRIDDGKKTFYSMIRVFAVDLLKHQAEDLFTVKLPPSAISIRTCEDSLRRALSNGTAEYLGWLVPGDEIIVDTSDKAFHTGQIGDLLRNFPVNSFRLTGFPSNSRLRLKPVLLAGEGLRDDAEDSIKKILLGQGWRPAINVLFSKGKPRIVRRNSLGIERPSSNNGLPFSWEA

SEQ ID NO: 542 - protein, 1233 aa, Mycoplasma canis
MEKKRKVTLGFDLGIASIGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTNANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNELLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISTNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNPDTSKTPKRLMFGIKSIMNNYEQVDISPFGINKKIFE

SEQ ID NO: 543 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTIESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSIDKLNILLNLFNLPISEKKKKLTSANINDIVKKESTKSIMLSVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDAILPKLLDNNEGWNLEAIKNYDEEIKSQIEDNSFLMAKQDKKYLNDNFLKDAILPPNVKVTFQQAILIFNKIIQKFSKDFEIDKVVIELAREMTQDQENDALKGIAKAQKSKKSLVEERLEANNIDKSVFNEKYEKLIYKIFLWISQDFKDPYTGAKISANEIVDNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDDKKMFKVIAMNGAVTSFIRKNMSYDNKLRLKNRNDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKLSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 544 - protein, 1233 aa, Mycoplasma canis; identical to SEQ ID NO: 247

SEQ ID NO: 545 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEENAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKSHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGMAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDKFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 546 - protein, 1233 aa, Mycoplasma canis
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMLSVEDIDMIKYEWAGKEPNVYGVGLSGLNIEESAKENKFKFQDLKILNVLINLLDNVGIKFEFKDRNDIIKNLELLDNLYLFLIYQKESNNKDSSIDLFIAKNKSLNIENLKLKLKEFLLGAGNEFENHNSKTHSLSKKAIDAILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFDDKYEKLIYKIFLWISQDFKDPYTGAKISANEIVNNKVEIDHIIPYSLCFDDSSANKVLVHKQSNQEKSNSLPYEYIKQGHSGWNWDEFTKYVKRVFVNNVDSILSKKERLKKSENLLTTSYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIAAKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 547 - protein, 1239 aa, Mycoplasma cynos
MEEKRKVTLGFDLGVASVGWAIVDSETNEVYKLGSRLFDIPDTNIDRRAKRGSRRLVRRRSYRNQKFYNLIKRTKTFGFLDKEAIEKEFVLLSIKYPNIIELKVKGLQEEVSKSEAVWILHDYLKNRGYFYDDKEEKDDLENPSIESMPSYKLYEFYKEYGYFKGALSSPTESEKNKDSDLEKAIFFNFSNKEWTKEINHFFKIQKNIFSEDFKAKFMEFFSFIRDISKGPGSENMPSQYSIFGKYGDDGMGGKYQHIWDKNIGKCSIFKDKVRAPKYLPSALFFNLLNELSNIRLYSVDKREKSVLWRLSSKDKINIILNILQIILFKNDGKISNLDINKIVKNESIKSIILNEIDLDLIKDMWFEKEPNVYGIGLSGLNIEENKKENRFKFQDLKIFSVFIDLLKKSNINIEFNNEKDIIHNLKLLDELYFFLITQKYSRDKYGSIKKFILNNKSFNIDNLDEKLNIFLSISDDEFDNHNSKTHSLSKEAIYFIFPKLLHNNEGWNLEAIKNYDIDVREEISKHSFGIKKQDKKYLDDAFLDDAILPPSVKVTIKQSILIFNKIIKKFSNKFQIDNVVIELAREMTQEKEMDAQKSLNRLKKSRKKIIEERLNANNIDSKMFRDKTGEISPNYIYKIYLWISQNFKDPYTGENISANDILKNNVEIDHIIPYSLCFDDSSSNKVLVFKHSNQSKGNFLPFDMISTFSENSVWNWKEYTQYVEKTFKTNLESILDKKERVKKADNLLTSSYDGYDKLGFLARNLNDTRYATILFRDQLINYSENHLIDSKKMFKVIAMNGGVTSFIRKNMSFDSGLKVKDRSIFSHHAYDAAIIALFSNKTKILYNLINPSLDGIISKRSEGYWVLEDRLTGEIRKLNYNDWQSIKNNVEVKKIAREIESHLSNLDNVVMFSRKSKRKTNKELYNETLYGIATRIDENGIKNYYKKEKFNILEDENIYLRLLNERENFIINRSNPEVIDAIIEIFETIDKNKIPARDVAKNIKYTDNKIKYNLYLKDYMRKLVDEFPDKFRKDFIEQMIAKKIFILFNPIKNTTRKIKSLRSINNNKIEDIRKKQVLEKFNTAKNEPRSFYESLNSLGAIIFKNNLNIYKKMSISSQIATFGDKNWKIDDINTYNKEKLNKYKEIYGIDETYDFYSFIFPGTILLDEKNKEFLYISSIQTLKDKIELKFLDRIEFEKKNVNSNLKPKIKREIISTKKLMSDYKIIKISPLGINKKIFE

SEQ ID NO: 548 - protein, 1269 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKKKKANRFLMTLSTILNDYILLDAKDNFDILGLSKNRIDEILNSKLGLDKITK

SEQ ID NO: 549 - protein, 1224 aa, Mycoplasma gallisepticum
MNNSIKSKPEVTIGLDLGVGSVGWAIVDNETNIIHHLGSRLFSQAKTAEDRRSFRGARRLIRRRKYKLKRFINLIWKYNSYFGFKNKEDILNNYQEQQKLHNTVLNLKLEALNAKIDPKALSWILHDYLKNRGHFYEDNRDFNVYPTEELANYFGEYGYYKGIIDSKEDNDDKLEEGLTKYKFSNQHWLEEIKKVLSNQTGLPEKFKEEYESLFSYVRNYSEGPGSINSVSPYGIYHLDEKEGKVVQKYNNIWDKTIGKCSIFPDEYRAPKNSPIAMIFNEINELSTIRSYSIYLTGWFINQEFKKAYLNKLLDLLIKTNSEKPIDARQFKKLREETIAESIGKETLKDVEREEKLEKEDHKWKLKGLKLNTNGKIQYNDLSSLAKFVHKLKQHLKLDFLLEDQYTTLDKINFLQSLFVYLGKHLRYSNRVDSANLKEFSDSNKLFERVLQEQKDDLFKLFEQTDKDDEKILAQTHSLSTKAMLLAITRMTNLDNDEDNQKNNDKGWNFEAIKNFDQKFIDITKKNNNLSLKQDKRYLDDRFINDAILSPGVKRILREATKVFNAILKQFSEEYDVTKVVIELARELSEEKELENTKNYEKLIKKNSDKISERLEALDIAEDKIEDILKSPTKSYKVLLWLQQDHIDPYSQKEIAFEDILTKTEKTEIDHIIPYSISFDDSSSNKLLVLAESNQAKSNQTPYEFITSGNAGIKWEDYEAYCRKFKDGDTSLLDSTQRSKKFAKMMKTDTSSKYDIGFLARNLNDTRYATIVFRDALKDYANNHLVEDKPMFKVVCINGGVTSFLRKNFDKSWYAKKDRDKNIHHAVDASIISIFSNETKTLFNQLTQFADYKLFKNTDGSWKKIDPKTGVVTEVTDENWKQIRVRNQVSEIAKVINKCIQDSNIERKARYSRKIENKTNISLFNDTVYSAKKVGYEDQIKRKNLKTLDIHESAEENKNSKVKKQFVYRKLVNVSLLNNDKLADLFAEKEDILMYRANPWVINLAEQIFNEYTENKKIKSQNVFEKYMLDLTKEFPEKFSEAFVKSMLRNKTAIIYNVEKKVVHRIKRLKILSSELKENKLSNVIIRSKNESGTKLSYQDTINSIALMIMRSIDPTAKKQYIRVPLNTLNLHLGDQDFDLHNIDAYLKKPKFVKYLKANEIGDEYKPWRVLTSGTLLIHKKDKKLMYISSFQNLKDVIEIKNLIETEYKENDDSDPKKRRKQIGS

SEQ ID NO: 550 - protein, 1269 aa, Mycoplasma gallisepticum; identical to SEQ ID NO: 138

SEQ ID NO: 551 - protein, 226 aa, Mycoplasma iowae
MSNKKKITIGLDIGVSSVGWSILREDNVLIDYGSRLFPDAANAKDGKLENEARRSHRSMRRRIRRIKTRKNDLIKLLIKYNIISDQDELAKILEQGIVNETGNVPIVEIKYKGLKEKLSKEELLICLYHYIHKRGYFYITEEDLKENGENINRLPTEIQYDFYMKNGYYIGNEDNQKFSNLIWVKEIEKFLSKQSLDSNFVDEYISLFRRVRDYSDGPGSEKSPTP

SEQ ID NO: 552 - protein, 1304 aa, Mycoplasma synoviae
MLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 553 - protein, 1401 aa, Myroides injenensis
MKRILGLDLGTTSIGWAYVHEAENVNETSSIQKVGVRVNPLTTEEQTNFEKGKPITTNASRTLARSARRNLQRYKLRRDNLIQILKENNWINNTTSLTETGNHSTFETYELRNKAASEKLTLDQLSRVLLMLNKKRGYKSSRKVNSKEEGQLIDGMEVAKKLYHEQLTPGQLSLQLMNQGVKKLPDYYRSDLNQELESIWNFQQQFYPNILTDKFKEEINGKGLTSTSSAFWNIYNFNTAENKGSRDEKKKQALQWRSEALSKQLSKEIVAYIIADLNGQIYNSSGYLGAISDRSKELYFNNLTVGQYLFKQLKSNPHTSLKNQVFYRQDYLNEFEKIWETQSKFYPKELTAALKREIRDVIIFYQRKLKSQKGLISFCEFEQKQKTINGKTKTIGHRVIPKSSPLFQEFKIWQQLHNVVLRNKKTNEIVSLADEQKVHLFEELNLKGKLKSNQVLKLIENKPKDWELNYTELEGNNTNKALYNAYLDILDIEGYDVRNELKVKLNKDDIELSDLDVNASEIKEMIFSVFKHLGINTEILEFDATLEDKVFEKQASYQLWHLLYSYEEDNSPTGLDRLYNLLHKKFGFKLNHAKLIGNVLFQDDYGSLSSKAIKNIFPYITENNYYTACELAGYKHSKHSLTKEENETRELKNRLTILPKNSLRNPVVEKIINQMINVVNTLIDEENNILIAQGKEPNFQFDEIRIELARELKKNAKEREELTKSINKSKTDHEKIIKILQKEDGIKNPTRNDIVRFKLYSELKNNGYKDLYTNEYIERKDIFTKEYDIEHIIPQSKLFDDSFSNKTLVRRNVNLKKGNQTAYDFILCEYGQEKANEFETRITNLYNLGKDEGISKSKFKKLLMQESEIGNGFIERDLRETQYIAKKAKSLLLEITRNVISTSGSITDRLREDWGLINVMKELNLQKYRDAGLTEFVKMKDGNKKEVIIDWTKRNDHRHHAMDALTIAFTKHNHIQYLNHLNARKNVNNELHNNIIAIEKLETTLVSDERGNKKRIFKEPIANFRTIAKSHLEAILVSHKAKNKVVTKNINKISGKKISQQTLTPRGQLHKETIYGKIRQYVSKQEKVGPKFTIEVIEQVSNPTYRNLLLKRLEENNNDPKKAFGGKNSLNKNPIYINLEKNIKVPEVLKLVWLEDNYTIRKEISPDLKIDKVIDQGVKQILQNRLAQYKGDSKLAFSNLDANPIWLNEDKGIAIKRVTISGIATAQPLHRKKDHLGQPILDHNGQEIPVDFISTGNNHHVAIYEDENGKLQESVVSHFEAVERVNQKLPIIDKTFNQHLGWKFLFTMKQNELFLFPSDDFNPNEIDLFDKQNYTVISKHLFRIQKLSTKDYSFRHHLETNVEEIKDLKTITWRREGLNGIQNIIKVRTNHLGEIIHIGEY

SEQ ID NO: 554 - protein, 1466 aa, Myroides odoratus
MKNILGLDLGTNSIGWALVKEDFENKQGEILGLGSRIIPMSQDILGEFGRGNSISQTADRTGYRGVRRLRERHLLRRERLHRVLNILGFLPNHYAKEIDFTKRLGKFINHAEPKLSFDKEFIFKDSFNEMLKDFQQNQPGFIINKHGEEALVPYDWTIYYLRKKALTQKIDKEELAWILLNFNQKRGYYQLRGEEEEENTNKLVEFYSLKIIDVIADNEVNKKGEVWYSLHLENGWIYRRSSKISLVDWKDKVRDFIVTTDVNDDGSEKLDKDGVVKRSFRAPSADDWTLLKKKTEQDIDNSNKTVGAYIYENLLLNPKQKIKGKLVRTIERKFYKDELKQILEKQKEFHQELQNEQLLQDCVRELYKYNEQHQQMLESKDFVHLFLNDIIFYQRPLRSQKSLISNCTLEKRVSRDGVVFPIKVISKSNPYYQEFRLLQWLQNLAIYRKDDDVNVTQEFLNSIESWENLLQFLNAKKEIKQEQLIKFLLEQKGLKGNSLKTAILTYRWNYVTDKVYPMNETRSLIQDKLKKVENVATDFLSFDNEMALWHIIYSVNDKIEYEKALAKFASKHNLDEISFVESFKKFPPFKSDYGSFSEKAIKKLLPLMRFGSVWNKNNIVPSVLDRIDKILTGEYDEKIKIRVREKAEQFQLNQIEDFQNLPLWLAQYVVYDRHSEAEIAGKWNSVKDLENYLKEFKQHSLRNPIVEQIITETLRVVKDIWQQYGNGVQNFFDEIHIELGREMKNTADERKRITNSVTENENTNLRIKALLVELKEDTNIENVRPHSPMQQEILKIYEEGVLNAVENIDEDILKISKTAQPSKSELIRYKLWLEQKYQSPYTGEMIPLSRLFTSDYEIEHVIPQSRYFDDSLSNKVICEAAVNKRKDNQLGLEFIKNHHSEKIELGNGRTAQVLEVEAYESFVKKNYDKNRGKRNKLLLEDVPEKMIERQLNDTRYISKFVTHLLSNIVRKDEVNSKDDGINSKNIIPGNGKITSQLKQDWGLNDVWNELILPRFERMNNLTNSTDFTSTNTNGKIIPTVPLEYSKGFSKKRIDHRHHALDALVIALATRDHVNLLNNESALPKKDRTKEEQKSFRFDLQVNLRNKEKYFNVKEGREKEKFTTFKKPWNTLTQDTRDALENMVVSFKQNLRVINKATNYYESYTDENGNLRLDKYGNPKKELISQKGTNWAIRKSLHKETVSGQIHLDRVKVTKGKIVTATRKSLDSSFNEKSIESITDTGIQKILRNYLKAKDNKPDVAFSPEGIEELNKSISVYNEGKNHQPIIKVRIFEQGSKFPVGETGNKIAKFVEAAKGTNLFFGIYQDKTGKRSYDTIPLNLVIERLKQGLSPVPETNEKGHQLLFHLSPNDLVYVPTIDDNEQLDSNRVYKFTDSSDTTCNFIPSNISAIIFNINSKEQEKRGINYPIQNELGVGSPQSKNQKSFDGFMIKEVCIKLKVDRLGNISKT

SEQ ID NO: 555 - protein, 241 aa, Neisseria lactamica
MAAFKPNPMNYILGLDIGIASVGWAMVEIDKEENPIRLIDLGVRVFERAEMPKTGDSLAMARRLARSVRRLTRRRAHRLLRARRLLKREGVLQDADFDENGLVKSLPNTPWQLRAAALDRKLTCLEWSAVLLHLIKHRGYLSQRKNEGETADKELGALLKGVADNAHALQTGDFRTPAELALNKFEKESGHIRNQRGDYSHTFSRKDLQAELNLLFEKQKEFGNPHVSDGLKEGIETLLMA

SEQ ID NO: 556 - protein, 666 aa, Neisseria lactamica
MAAFKPNPMNYILGLDIGIASVGWAMVEVDEEENPIRLIDLGVRVFERAEVPKTGDSLAMARRLARSVRRLTRRRAHRLLRARRLLKREGVLQDADFDENGLVKSLPNTPWQLRAAALDRKLTCLEWSAVLLHLVKHRGYLSQRKNEGETADKELGALLKGVADNAHALQTGDFRTPAELALNKFEKESGHIRNQRGDYSHTFSRKDLQAELNLLFEKQKEFGNPHVSDGLKEDIETLLMAQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYCKKNAEEKIYLPPIPADEIRNPVVLRALSQARKVINCVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKNNGFCCKNSMKKDLKNAT

SEQ ID NO: 557 - protein, 828 aa, Neisseria lactamica
MLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSTELQDEIGTAFSLFKTDKDITGRLKDRVQPEILEALLKHISFDKFVQISLKALRRIVPLMEQGKRYDEACAEIYGDHYGKKNTEEKIYLPPIPADEIRNPVVLRALSQARKVINAVVRRYDSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKAHFPQPWEFFAQEVMIRVFGKPDGKPEFEEADTSEKLRTLLAEKLSSRPEAVHEYVTPLFVSRAPNRKMSGQGHMETVKSAKRLDEGISVLRVPLTQLKLKDLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKAELKKETFFGYFSGLDRSTGNISLRSHDLDKTKGKDGVYRIGIKTALSFQKHQIDELGKEIRPCRLKKRPPVR

SEQ ID NO: 558 - protein, 408 aa, Neisseria lactamica
MNDTRYVNRFLCQFVADHILLTGKGKRRVFASNGQITNLLRGFWGLRKVRTENDRHHALDAVVVACSTVAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKGLEKMVNREREPKLYDALKAQLETHKDDPAKAFAEPFYKYDKAGSRTQQVKAVRIEQVQKTGVWVRNHNGIADNATMVRVDVFEKGGKYYLVPIYSWQVAKGILPDRAVVAFKDEEDWTVMDDSFEFRFVLYANDLIKLTAKKNEFLGYFVSLNRATGAIDIRTHDTDSTKGKNGIFQSVGVKTALSFQKTKSTNSAKKSDHAV

SEQ ID NO: 559 - protein, 1082 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 560 - protein, 976 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGIFAG

SEQ ID NO: 561 - protein, 1081 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVADNAHALQTGDFRTPAELALNKFEKESGHIRNRRGDYSHTFSRKDLQAELDLLFEKQKEFGNPHISDDLKEGIETLLMTQRPALSGDAVQKMLGHCTFEPTEPKAAKNTYTAERFVWLTKLNNLRILEQGSERPLTDTERATLMDEPYRKSKLTYAQARKLLELDDTAFFKGLRYGKDNAEASTLMEMKAYHAISRALEKEGLKDKKSPLNLSPELQDEIGTAFSLFKTDEDITGRLKDRVQPEILEVLLKHISFDKFVQISLKALRRIVPLMEQGKRYDEACAEIYGDHDGKKNTEEKIYLPPIPADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHMLLTGKGKRRVFASNGQITNLLRGFWGLRKVRAENNRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 562 - protein, 1081 aa, Neisseria meningitidis
MAAFKPNPINYILGLDIGIASVGWAMVEIDEDENPICLIDLGVRVFERAEVPKTGDSLAAARRLARSVRRLTRRRAHRLLRARRLLKREGVLQAADFDENGLIKSLPNTPWQLRSAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEGWTVIDESFRFKFVLYSNDLIKVQLKKDSFLGYFSGLDRATGAISLREHDLEKSKGKDGMHRIGVKTALSFQKYQIDEMGKEIRLCRLKKRPPVR

SEQ ID NO: 563 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGEEIRPCRLKKRPPVR

SEQ ID NO: 564 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 565 - protein, 1082 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSSDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLYQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 566 - protein, 1081 aa, Neisseria meningitidis
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAKLALNKFEKESGHIRNQRGDYSHTFSRKDLQAELNLLFEKQKEFGNPHISDGLKEGIETLLMTQRPALSGDAVQKMLGHCTFEPTEPKAAKNTYTAERFVWLTKLNNLRILEQGSEQPLTDTQRAKLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYNEACAEIYGDHYGKKNTEEKIYLPPIPADEIRNPVVLRALSQARKVINGVVRRYGSPARIHIETAREVGKSFKDRKEIEKRQEENRKDREKAAAKFQEYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 567 - protein, 1081 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLSLEDTAFFKGLRYGKDNAEASTLMEMKAYHTISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 568 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKECGHIRNQRGDYSHTFSRKDLQAELNLLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEEGFKERNLNDTRYVNRFLCQFVADHILLTGKGKRRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGGKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 569 - protein, 1081 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRVQPEILEALLKHISFDKFVQISLKALRRIVPLMEQGKRYDEACAEIYGDHYGKKNTEEEIYLPPITADEIRNPVVLRALSQARKVINAVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKENSREWQEFKARVETSRFPRSKKQRILLQKFDEDGFKERNLNDTRYVNRFLCQFVADRMRLTGKGKKRVFASNGQITNLLRGFWGLHKVRAENDRHHALDAVVVACSTIAMQQKITRFVRYKEMNAFDGKTIDKETGEVLHQKAHFPQPWEFFAQEVMIRVFGKPDGKPEFEEADTPEKLRTLLAEKLSSRPEAVHEYVTPLFVSRAPNRKMSGQGHMETVKSAKRLDEGISVLRVPLTQLKLKDLEKMVNRAREPKLYEALKARLEAHKDDPAKAFAEPFYKYDKAGNRTQQVKAVRVEQVQKTGVWVRNHNGIADNATMVRVDVFEKAGKYYLVPIYSWQVAKGILPDRAVVAYADEEDWTVIDESFRFKFVLYSNDLIKVQLKKDSFLGYFSGLDRATGAISLREHDLEKSKGKDGMHRIGVKTALSFQKYQIDEMGKEIRPCRLKKRPPVR

SEQ ID NO: 570 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADKIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 571 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVANNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSSELQDEIGTAFSLFKTDEDITGRLKDRVQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLVRLNEKGYVEIDHALPFSRTWDDSFNNKVLVLGSENQNKGNQTPYEYFNGKDNSREWQEFKARVETSRFPRSKKQRILLQKFDEDGFKECNLNDTRYVNRFLCQFVADHILLTGKGKRRVFASNGQITNLLRGFWGLRKVRAENDRHHALDAVVVACSTVAMQQKITRFVRYKEMNAFDGKTIDKETGKVLHQKTHFPQPWEFFAQEVMIRVFGKPDGKPEFEEADTPEKLRTLLAEKLSSRPEAVHEYVTPLFVSRAPNRKMSGAHKDTLRSAKRFVKHNEKISVKRVWLTEIKLADLENMVNYKNGREIELYEALKARLEAYGGNAKQAFDPKDNPFYKKGGQLVKAVRVEKTQESGVLLNKKNAYTIADNGDMVRVDVFCKVDKKGKNQYFIVPIYAWQVAENILPDIDCKGYRIDDSYTFCFSLHKYDLIAFQKDEKSKVEFAYYINCDSSNGRFYLAWHDKGSKEQQFRISTQNLVLIQKYQVNELGKEIRPCRLKKRPPVR

SEQ ID NO: 572 - protein, 1082 aa, Neisseria meningitidis
MAAFKPNPINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTLWQLRAAALDRKLTPLEWSAVLLHLIKHRGYLSQRKNEGETADKELGALLKGVAGNAHALQTGDFRTPAELALNKFEKESGHIRNQRGDYSHTFSRKDLQAELNLLFEKQKEFGNPHISDGLKEGIETLLMTQRPALSGDAVQKMLGHCTFEPTEPKAAKNTYTTERFIWLTKLNNLRILEQGSERPLTDTERATLMDEPYRKSKLTYAQARKLLELDDIAFFKGLRYGKDNAEASTLMEMKAYHAISRALEKEGLKDKKSPLNLSPELQDEIGTAFSLFKTDEDITGRLKDRIQPEILEALLKHINFDKFVQISLKALRRIVPLMEQGKRYDEACAEIYGDHYGKKNTEEKIDLPPIPADEIHNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLTEKLSSRPEAVHEYVTPLFVSRAPNRKMSGQGHMETVKSAKRLDEGISVLRVPLTQLKLKDLEKMVNREREPKLYEALKARLEAHKDDPAKAFAEPFYKYDKAGNRTQQVKAMRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 573 - protein, 1082 aa, Neisseria meningitidis
MAAFKPNPINYILGLDIGIASVGWAMVEIDEEENPIRLIDLSVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFVWLTKLNNLRILEQGSERPLTDTERATLMDEPYRKSKLTYAQARKLLGLEDTAFFKGLRYGKDNAEASTLMEMKAYHAISRALEKEGLKDKKSPLRLSPELQDEIGTAFSLFKTDEDITGRLKDRVQPEILEALLKHISFDKFVQISLKALRRIVPLMEQGKRYDEACAEIYGDHYGKKNAEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 574 - protein, 1082 aa, Neisseria meningitidis
MAAFKPNSINYILGLDIGIASVGWAMVEIDEEENPIRLIDLGVRVFERAEVPKTGDSLAMARRLARSVRRLTRRRAHRLLRTRRLLKREGVLQAANFDENGLIKSLPNTPWQLRAAALDRKLTPLEWSAVLLHLIKHRGYLSQRKNEGETADKELGALLKGVAGNAHALQTGDFRTPAELALNKFEKESGHIRNQRSDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTLEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 575 - protein, 67 aa, Neisseria meningitidis
MFGYFASCHRGTGNINIRIHDLDHKIGKNGILEGIGVKTALSFQKYQIDELGKEIRPCRLKKRPPVR

SEQ ID NO: 576 - protein, 220 aa, Neisseria mucosa
MRHIFSDGLKEGIETLLMTQRPALSGDAVQKMLGHCTFEPTEPKAAKNTYTAERFIWLTKLNNLRILEQGSERPLTNTERATLMDEPYRKSKLTYAQARKLLGLKDTAFFKGLRYGKDNAEASTLMEMKAYHAISRALEKEGLKDKKSPLNLSPELQDEIGTAFSLFKTDEDITGRLKTELTPASNKTLSRPFTVKSASNGSTSAPWLPSTKWFLHFKPA

SEQ ID NO: 577 - protein, 392 aa, Neisseria sp.
MAPFTLKPLNYILGLDIGIASVGWAVVETDSDVLPYRLIDVGVRTFDRAEVPKTGESPAAARRLARSVRRMIRRRAHRMLRARRLLKREGMLQAADFDAHGLVENLPVNPWQLRVDALSRKLMPLEWAAVLLHMVKHRGYLSQRKNERNSSDKELGALLSGVAANSEALQGGDFRTPAELAVNKFEKESGHIRNQRGDYSHTFNRKDVQAELVLLFEKQKEYGNPYISDGLLTGVEDLLMTQRAALSGDAVQKMLGRCTFEPEEYKAAKNTYSAERFVWLTKLNNLRILDQGSERPLTDSERAKLMDEPYKKTKLTYAQVRRLLELDDTAFFKGLRYSKDNAESATLMEMKAYHSISGALEKAGLKNKKIAAGLIARIAGRNRRGVFAIQNR

SEQ ID NO: 578 - protein, 701 aa, Neisseria sp.
MQDEIGEAFSLFKTDEDIRGRLKGKLPDEQLDALLEYVSFDKFVQLSLKALRKILPLMEQGKRYDEACAEIYGDHYGIKDDKQAQFLPPVSADEIRNPVVLRALSQARKVVNAVVRRYGSPARVHIETAREVGKSFLDRKKIEKRQEENRKDRERSIAKFREYFPNFVGEPKAKDILKMRLYEQQQGQCLYSGKAIDLRRLNEKGYVEIDHALPFSRTWDDSFNNKVLVLAGENQNKRNQTPFEWLGGDEKRWREFTARVEHCRFPRSKKQRILMQKLDEKDFKERNLNDTRYVNRFLCNFIAQNMLLTGEDKNRVFASNGQITNLLRGMWGLKKVRESNDRHHALDAVVVACSTVAMQQKITNYVRQKEMNVFDGEMVDKTTGEVSRLHFPQPWDFFRQEVMMRVFGKPDTPSENNEEADTPEKLRALLADKLSSRPEAVHEAVTPLFVSRAPSRKMSGQGHMETIKSAKRLSEGKSVLRVPLTQLTPKLLENMVNREREPQLYEDLLGRLNAHGGDPAKAFAAPFFKRDKAGNPTQQVKAVRVEDVQKSGVIVREGNGVADNATMVRVDVFEKGGKYYLMPIYTWQAAKGILPNKAVIAHTDEANWQEMDTSFTFKFALYPNDLVLASLKKETYFGYFAGLDRSTGNISLRVHDLEKSKGKDGVYRIGVKTALSFQKYQVDELGKTIRPCRLKKRPPVR

SEQ ID NO: 579 - protein, 1089 aa, Neisseria sp.
MTAFKPNPLNYILGLDIGIASVGWAMVEIDDKENPVRLIDLGVRVFERAEMPKTGDSLAAARRLARSVRRLTRRRAHRLLRARRLLKHEGVLKPEDFDENGLVKPLPYIPKQPRNTPWQLRAAALDRKLTPLEWAAVLLHLVKHRGYLSQRKNEGETDDKELGALLKGVADNTHALQAGNFRTPAELALNKFEKESGHIRNQRGDYSHTFSRKDLQAELVLLFEKQKEFGNPYVSDDLKNGIENLLMTQRPALSGDAIQKMLGHCTFEPAEPKAAKNTYTAERFIWLTKLNNLRILNQGNERPLTDAERTTLMDEPYKKSKLTYAQARKLLDLDDTAFFKGLRYGKDNAESATLMEMKAYHAISRALEKEGLKDKKSPLSLSPELQDEIGTAFSLFKTDEEITGRLKGCLQPEILDALLKHISFDKFVQISLKALRRIVPLMEQGKRYDEACAEIYGDHHGRRNSEETLYLPPIPADEIRNPVVLRALSQARKVINGVGRRYGSPARIHIETAREVGKSFKDRKEIEKRQEENRKDREKAAAEFQEYFPNFVGEPKSKDILKLRLYRQQNCKCLYSGKEINLGRLNEKGYVEIDHALPFSRTWDDSFNNKVLVLGSENQNKGNRTPYEYLNGKDNSREWQEFKARVETSRFPHSKKQRILLQKFDEEGFKERNLNDTRYVNRFLCKFVADHMQLTGKGKRRVFASNGQITNLLRGFWGLRKVRAENDRHHALDAVVVACSTVAMQQRITRFVRYKEMNAFDGKTVDKETGEVLHQKTHFPQPWEFFAQEVMIRVFGKPDGKPELEEADTPEKLRALLAEKLSSRPEAVHEYVAPLFVSRAPNRKMSGQGHMETIKSPKRLDEGISVVRVPLTQLKLKDLEKMVNREREPKLYEALKARLEAHKDDPAKAFAEPFYKQDKAGNRTQQVKAVRIEQVQKTGVWVRNQNGIADNATMVRVDVFEKGGKYYLVPIYSWQVAKGILPDKAIIAFKDEEEWQLIDDSFNFKFPLHPNDLVEVITKKARIFGYFASCHRGTGNINIRIHDLDNKVGKNGILEGIGVKTALSFQKYQIDELGKEIRPCRLKKRPPVR

SEQ ID NO: 580 - protein, 1097 aa, Neisseria wadsworthii
MKKQPQRYILGLDLGIASVGWALILVDGAENPVGLLDCGVRTFERAEVPKTGDSLALARRQARSVRRLIRRRAHRLLRLRRLLKREGILSAADFNSDGLPNLPIDAWQLRVAGLERKLTNQEWAAVLLHLVKHRGYLSQRKSETQTENKELGRLLAGVAENSKLLSESSEQYRTPAELAVKLFAEQSGHLRNKGGEYTHTFNRLDLQKELHLLFERQYALGNPFASAELQSKVDELLMTQRSALQGEAVLKMLGKCTFEPSEYKAAKNTYSAERFIWLTKLNNLRILYNGEERALDEGDRKKLLDEPYKKAKLTYKQVRSILNLPESAVFKGLRYGKDSDGLKAENGTLMEMKAYHKIRTILDKAGLKGEWENRIRNPEILDKIGTAFSLYKTDEDIQAALADLRLPENVLDALLAGLNFDKFIQLSLKALRNILPLMERGIRYDEACKEVYGDHRALAESKNQVLLPPIPADEIRNPVVLRTLTQARKVINAIIRRYGSPQRVHIETARELGKSKQERDKIDRKNKENQNDRNRLASDIRKHFNFEPTPKDILKLRLYEQQHGKCLYSDLREEKGECLYTGNVIELHRLFEDGYVEIDHALPLSRTWDNSLNNKVLVLKSSNQNKGNKTPYEWLDGANNSRRWREFQARVQGCHFPYVKKQRIQTAKLDSKAEQGFLERNLNDTRYISKFMCQFITANLRLAETSNALMEEVAGENPYWKERKRQRVFAPSGSIIALLRGLWGLKKVREDNDRHHALDAIVVACSTVSMQQKITKAMQRRETLETVDSETGEVKTRIPQPWDFFRQEVMIRVFSDSPREELAEKLNSRPEALHDFVSPLFVSRAPNRKMTGQGHLETVKSAKRLSENISVVRKPLTALKLKDIENIVGYPDREPALYQALRERLLAHKDDPVKAFADKPFYKPAKDGGQGSLVKAVRIIENTKHGLKIRNGITDTNGDMVRTDVYQKTDKKGKRQYFIVPVYAWQVEKNELPTVDCKGYEIDDNYEFCFSLYKYDLIEIQNPNDINQELRAYYINCDSSDGRFWLAYHDKSAKEQQFRISTQNQPIIKKYQVDTLGKEIRLCKAEKRTALNGKKKK

SEQ ID NO: 581 - protein, 1426 aa, Niabella soli
MPRKNILGLDLGTTSIGFAKIIEDDDYQCSSVELIGVRVNPLTTDEQTNFEKGKPVSVNADRTLKRGMRRNLDRYQLRRDYLIEILRTHHIITADTKLAEDGKNTTHTTYALRALAATAEIPLEAFVRVLLAINKKRGYKSSRKAKNEDEGQLIDGMAIARRLYEESLTPGQFSYQLLKEGKKYLPDFYRSDLNTELNKVWNFQKQFYPEILTDEFKRHLEGKGQRATAVAFWGQHGFSMAENKGSREEKKLHAYKWRSEAAHKQLTKEEVAFVITEINNDLNKSSGYLGAISDRSKELFFNKQTVGQYLHQQLKENPHTRLKGQVFYRQDYLDEFETIWEMQAKFYSALTLELKEEVRDVVIFYQRKLKSQMGLISLCEFESKEIEIEKNGEKAKKRIGLRVAPKSSPLFQEFKIWQVLNNLEFRNKKTKEVFVPEMAAKQQLFDELNIKGNLLASEAIKILGYKTKDWEANYHTLEGNRTNKSLYDAWLKILELEGYDENLLKLSGSDDIDVSKIEKPALEIRQMVLAVFEVLGISGAILDFDAEADGKAFEQQPAYQLWHLLYSAEDDGKKYSQEDIFTYGHDNIGLKKKLCEKFGFRPEHTKILVNVVFSDDYGNLSSKAMRRIYPFIKELTYDKACAEAGYRHSAASLTKEEIAARPLQNRLDLLKKNELRSPVVEKILNQMVNVVNTLVDDENQNRKARGLSEDFHFDEIRIELARELKKNAKERAEMTTNINTAKQSHEKIIRILQTEFGVPNPSRNDIVRYKLYEELKNNGYKDLYTNTYISRDILFSKQIDVDHIIPQMSLFDDSFSNKTVVFRKDNQDKGNKTAYDYILGKYGEQALEEYISRITSLFELGKKNKEEGIGKAKFQKLQKRLVDIGDGFIERDLRESQYIAKKANNMLYAICRSVVSTSGEITARLREDWDLVNVMQEINLPKFRALGLTEMVEKKDGAQKERITDWTKRNDHRHHAMDALAIAFTRHSHIQYLNHLNARKDEANKWHPVVSKIEEKETVLIYDDLGNRKRKFKAPMPNFREVVKEHLENVLISHKAKNKVVTKNKNKIKTVRGEKVKTELTPRGQLHKETIYGRYRYYESKEEKIGPKFDAEMIGMVTNPQYKKLLLERLAANGNDPKKAFWGKNALNKNPLYVDEARQELLPEKILLRWLNDDYSIRKDVTPENLKDIKTIEKILDKGVKKILLKRLADFGNDPKKAFSDLDKNPIWQNEAKRIAIKRVTISGIKNAAPLHHKKDHLGNDILDEKGKQIPSSFVSTGNNHHVAIYRDAEGNLQERVVSLFDAVQLVNGGEPVIDKEYNKGIGWQFLFTMKQNEMFVFPDEKTGFNPREVDLLSSGNRKLISPNLFRVQKLASKNYFFRHHLETSVEEKKELKNIAYKPQLGLNALSNIVKVRINHIGEIVSVGEY

SEQ ID NO: 582 - protein, 79 aa, Nitritalea halalkaliphila
MPLRLPERVYKMISSTGAECHFLPVNVSSLIKGYDAKSKLGEFGSQNKQEVTSDSFIRVKERCYKLEINRLGIPLNRLK

SEQ ID NO: 583 - protein, 1498 aa, Odoribacter laneus
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 584 - protein, 1389 aa, Oenococcus kitaharae; identical to SEQ ID NO: 241

SEQ ID NO: 585 - protein, 1535 aa, Ornithobacterium rhinotracheale
MNTILGLDLGTNSIGWALIKVLNDKTRLPLEIIDLGVVVIPTDQRTLDKFSKGESISKTAERTKQKGVRKLYERKKLRRERLHRVLNILGFLPEHYSKKIDFKKHLGQFFGNSQPKISYVENDHGKHEFIFMDSYREMLKEFSKHNIKNVPYDWTIYYLRKKALSQKISKEELAWVILNFNKKRGYYQFRDDNADENKENKIEKYYALKVTNVKKEDAQNYTITLENGWIYKNKSKISLLDWVGSTKEFISTEKFDNKGNIIKKKNGEDDRTLKLVDSEKDWIAIKKSTEDRIENYGKTVGTYLYEHLLKDPNQKLNGELINIIDRKFYKNELKQILEKQKEFHPELLNEDLFQKSIIELYPKNSTRQKELKNKDLCYLLIDDVIYYQRDLKKKNSTINKCSFESREYYLNGEKQIQKINCIAKSKPLYQEFRTLQFIKNLKVYEIIDGLEKDITSKLLPDFETKEHFFEWLNDKEKIDQLQLLSYKCFDLHDNVKNDLIAKGIKRPTEKAIRTELLEKYRWNYSKDNDRNFLLNETRFKILKYLKKVDKKLTLTNEQIESLWLLLYSAKDERELKNGLQKFSEKNKLPKKFSDIFISFPPFKKEYGAYSEKALKKLLSLVRFGKYWSFNKIDNNIQNKIMNILNGEVDDSISDRVREKTILLQDKNDFQDLPLWLASYVAYNRFSEVSEIKYWDSPDKIEFLKQHSIGNPIVEKIINETLKLIKDIWVIHGKSCKNFFSEIHIELSREIKSSSKKRAQITNNNTKNQKLNNLIKSLLIEMASDTKYENVTPYSPSQQEILKIYDEGIYSKEENSEKIKEINKIRNNNKISKSDITKYKLWLEQGYISPYTGKIIPLTKLFTAKYQKEHIIPQTKFFDDSFNNKVICEAEVNKLKDNSLAMNFIKAKGGKAVKLSDGETVTILNQEEYKQLVRTSFKKNSIKLRNLLLEEIPDTFTKRQLNDTKYISKLVLSLLSNIVREKGELESTAKRIVSTNGQITSILRNDWGLNNIWNKLITPRFERLNNINKNKIYGNWENKKGKNVFQINYLNDNLSTLNTKRIDHRHHALDALIVACTTRNHINFLNNQYAKSRNQRHDLRAKLKRRETITTEGSKKQVFKDFIKPWESFTQDALKKLETTIVNFKVNKRIINKTINWYKKWEKQKDGTYKKIQKKQTKGDAWAIRKPLHIDTIYGIVCKKLPLKSALENYKNIIDENLKHKIKELKEVNKFDNNQIINFFKECNFIFEDNNIQKVEVYDFKDNRDKTILSSSRQLIDESFTPKKIGKVLDPTIRNILLKHLNSTKYNNKFDSDGNPIKPEKLAFSPEGLKDLNKNIKHLNNNKEHQPIKRVKLFETLGNKIKVGYTQQKNKKFAETATGTNLFLGIYSDNNKRDFKTIPLILAIQREKEGLNPCPDTDEKGNQLLFSLSPNELVFVPNNEERKNPNLVDFENLSKDQIDRIYKFVSCTGSEAYFVPSRTAKPIIENENGTNNKSQRIIEFNEKTSIKNEKNEPVLIKTICWKIEVNRLGKIIKVIK

SEQ ID NO: 586 - protein, 103 aa, Parabacteroides merdae
MIVYRLFYRFLFKATKLVNFVIHKELKRQIARTGKIKFHSGGCGCQSGNYKMQNFEKGKSITTNADRTLKRSMRRNLYRCKLRRDVLIELLKKVGFIPEKQWK

SEQ ID NO: 587 - protein, 82 aa, Parabacteroides merdae
MSIWKLQYPPLDLKIYNKFLVYSRVNPLTVDEMQNFEKGKSITTNADRTLKRSMRRNLQRYKLRRDVLIELLKKVGFMSEKQ

SEQ ID NO: 588 - protein, 84 aa, Parabacteroides merdae
MSIWKLQYPPLDLKIYNKFLVYSRVNPLTVDEMQNFEKGKSITTNADRTLKRSMRRNLYRCKLRRDVLIELLKKVGFIPEKQWK

SEQ ID NO: 589 - protein, 398 aa, Pasteurella bettyae
MLANENQNKGNLTPYEWLDGKNNSKRWQDFVARVQTCCFSHRKKQHILSHKLDEKSFIERNLNDTRYVARFLCNFIADNMLLTGKGKRKVFASNGQITALLRGRWGLQKVRDDNDRHHALDAVVIACSTVAMQQKITRFVKYEEGNVFSGERIDRETGEIIPLYFPTPWKFFKENVEIRIFSENPKLELENRLPDYPQYNHEFVQPLFVSRMPTRKMTGQGHMETIKSAKRLDEGISVLKVPLTQLKLADLENMVNRERELALYEALKERLELFGNDPAKAFIEPFYKKGGALVKAVRVKKVQKSGVLVRDGNGVADNALMVRVDVFTKGGKYFLVPIYTWQVAKGILPNKAVTANIDEIDWLEMDESYQFIFTMYPNDLVKVKLKKEEFFGYYGGLD

SEQ ID NO: 590 - protein, 610 aa, Pasteurella bettyae
MNMLKPLNYILGLDLGIGSVGWAVVEIDEQGNPLRLIDVGVRTFERAEVAKTGESLALARRLARSSRRLVKRRAARIKKAKRLLKAENILLSVDEILPNDVWQLRVKGLDHKLERQEWAAVLLHLLKRRGYLSQRKNESKSENKELGALLSGVVTNHQILQTDEYRTPAEIAVHKFQAEDGHIRNQRGDYTHTFSRLDLLAEMELLFQRQTELGNLHTSSKLLENLTALLMWQKPALAGEAILKMLGKCTFEPTEYKAAKNSYSAERFVWLTKLNNLRILEQGAERALTDSERFVLLDQPYEKAKLTYAQVRTLLKLSDEAIFKGVRYQGEDKKTVESKTTLMEMKAYHQIRKALDGADLKDEWNTLKNDSALLDEIGTAFSLYKTDDDISHYLGGKLSEKVLNVLLENLNFDKFIQLSLKALQKILPLMLQGQRYDEAVSAVYGDHYGKKSAESCRLLPAIPANEIHNPVVLRTLTQARKVINAVVRLYGSPARIHIETGRKVGKSYQDRKKLEKQQEENREQRESAVKKFKEYFPNFVGEPKGKDILKLRLYELQQSKCLYSGKSFDPNRLLEKGYVEVDHALPFSRTWDDSFNNKVCLPMKTRIKAI

SEQ ID NO: 591 - protein, 199 aa, Pasteurella multocida
MACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNA

SEQ ID NO: 592 - protein, 63 aa, Pasteurella multocida
MQTTNLSYILGLDLGIASVGWAVVEINENEDPIGLIDVGVRIFERAEVPKTGESLALSRRLAR

SEQ ID NO: 593 - protein, 1058 aa, Pasteurella multocida
MQTTNLSYILGLDLGIASVGWAVVEINENEDPIGLIDVGVRIFERAEVPKTGESLALSRRLARSTRRLIRRRAHRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKESAESATFMELKAWHAIRKALENQGLKDTWQDLAKKPDLLDEIGTAFSLYKTDEDIQQYLEGKLPDSVINALLVSLNFDKFIELSLKSLRKILPLMEQGKRYDQACHEIYGHHYGEKNQQISQLLPVIPTQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKVRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYVGLKARLAEFNQDPAKAFATPFYKQGGQQVKAIRVELVQKSGVLVRQGNGVADNAPGSIVRTDVFIKNNKFFLVPIYTWQVAKGILPNKAIVAHKNEDEWEEMDEGAKFKFSIFPNDLIELRTKTECFLGYYIGPDRHNGSISLREHDSEISKGNAGVYRVGVKLALSLEKYHIDELGKNRRICRPHQRRPVR

SEQ ID NO: 594 - protein, 1056 aa, Pasteurella multocida
MQTTNLSYILGLDLGIASVGWAVVEINENEDPIGLIDVGVRIFERAEVPKTGESLALSRRLARSTRRLIRRRARRLLLAKRFLKREGILSTTDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVFLNFDKFIELALKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKIRENNDRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 595 - protein, 134 aa, Pasteurella multocida
MVNKEREPALYAGLKARLAEFNQDPAKAFTTPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKK

SEQ ID NO: 596 - protein, 53 aa, Pasteurella multocida
YSKENAESATFMELKAWHAIRKALENQGLKDTWQDLAKKPDLLDEIGTAFSLL

SEQ ID NO: 597 - protein, 1366 aa, Pediococcus acidilactici
MGDRKYNLGLDIGTSSIGFAAVDENNQPIRVKGKTAIGVRLFEEGKTAADRRGFRTTRRRLSRRRWRINLLNEIFDAHLAEVDPTFLARLKESNRSNLDPKKSFQGSLLFPERKDYQFYEEYPTIYHLRKALMEEDRKFDIREIYLAVHHIIKYRGNFLNGTPMRSFKVENIELDTLFDQLNQLYAEIVPDNELAFDLAQVADVKDVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYENHHHHLGLLKKVIENHPDAKKAKALKETYTAYVGKTDDKTQNQDDFYKAVEKNLDDSPDAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYQKFVVLNELNNLKINGRHLSLKDKQDVYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWRSTENFMQIQTRPEFAALIQQANEKQFEGNDPNNVWENIESILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDKLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGKYLYKCYPKLRPYFVYGKFKKFGDNEDIEVGDGRFNFLNRIERLKNVTDPETGEILWSNVAPNETIKQIKKVYNYKFMLVSRETTTRRAELFNQTVYPKNYRGKLIPIKEDRPTDLYGGYSGNTDAYLAIVALEDKKKGKYFKVVGIPTRAAAKLEKLKQQDSQQYLQALHKVIAPQFTKSTKKGIKKTEFEIVLDKVHYRQLVQDGPVKMMLGSSTYKYNAKQLVLSEKALQVIADDRKFDETQKDDNLIAVYDEILSIVNQSFDLYDINGFRKKLNDNRDQFIDLPAETKYEGRKVVAHGKREMILEILKGLHANAAFGNLKPIGFSTAFGQLQVPNGIILSKNAILIHQSPSGLFERKIKLSDL

SEQ ID NO: 598 - protein, 1229 aa, Pediococcus acidilactici; identical to SEQ ID NO: 130

SEQ ID NO: 599 - protein, 270 aa, Pediococcus lolii
LFNQTIYSAKASKTMIPIKNDRPTKLYGGYSGNEDAYMSIIRLSDKKKTYKVVGISMRDASKLKAYENNAHEEYLKKLKEVIEQQFLDSGKKTKADFEIVIPKVNYHQRMQDGTKQFRIGSSKYVHNTKQLVLSEKTLKAIRNNKQYNGDAEKDLINAFDEILTIVNDSFSIFDIRSFRKKLNESRDKFVSLPVEDTKEKSKVIKGKRETLKQILIALHANGTSQDIPQLGLKSFGKMVKTGGLTLSENTALIHQSPSGLFEHKIKLSDL

SEQ ID NO: 600 - protein, 1016 aa, Pediococcus lolii
MNGIFDAHLAEVDPTFLARLKESNRSNLDPKKSFQGSLLFPERKDYQFYKEYPTIYHLRKALMEKDRKFDIREIYLAVHHIIKYRGNFLNGTPMRSFKVENIELDTLFDRLNQLYEEIIPDNELAFDLEQVADVKEVLSSTTIYKMDKKKQLVKMMLLPASNKALQSENKKIVTQFVNAILNYKFKLDVLLQVETDADWSLKLNDEGADDKLEEFTGDLDENRLEIIDLLQRLHNWFSLNEITKDGNSLSAAMVEKYKDHRHHLELLKKVIEDHSDAKKAKALKETYTAYVGKTDDKTQNKDDFYKAVEKNLDDSPEAKEIKRLIQLDQFMPKQRTGQNGAIPHQLHQQELDQIIEKQSKYYPFLAEPNPNVKRRKDAPYKLDELIAFKIPYYVGPLVTPEEQAQNKENVFAWMKRKAAGPITPWNFDEKVDRMESANRFIRRMTTKDTYLFGEDVLPAESMIYEKFVVLNELNNLKINGRHLSLKDKQDIYNDLFKQQKTVSIKALQNYYVTKKKAATAPTVGGLADPKKFLSSLSTYIDFKNMFGERVNDPQFQEDLEQIVEWSTIFEDRGIFKAKLQALGWLSEKQIQQLVAKRYKGWGRLSKKLLTGLKNAEGYSILDEMWHSTENFMQIQTRPEFAALIQQANEKQFEGNDPDNVWENIENILGDAYTSPQNKKAIRQVVKVVQDIEKAVGNPPEKIAIEFTREAAANPQRTQSRLRTLEKLYESAEEVVDAGLTAELAEFKENKHVLSDKYYLYFTQLGRDVYTGDTISLDRLNDYDVDHILPQSFIKDDSLDNRVLTIRAVNNGKSDNVPAKMFGKKMGSFWRYLLDNGMISKRKYNNLITDPDNISKYAQKGFINRQLVETSQVIKLTANILNGIYDKDTEIIEVPAKMNSQMRKMFDLVKVREVNDYHHAFDAYLTIFIGNYLYKCYPKLRPYFVYDNFKKFGNKEDIGHKRFNFLGKIERDKKVVAPETGEILWSNVAPNETIKQIKKVYDYKFMLTSHETYTKHG

SEQ ID NO: 601 - protein, 1333 aa, Planococcus antarcticus
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 602 - protein, 211 aa, Porphyromonas catoniae
MGKKVLGLDLGVGSIGWCLITLDKDEKPQSILGMGSRIVPLSADDATEFTQGKAITKNKMRTVARTIRKGMDRYQLRREALKKVLREHAMLPDEALIKLPLLELWELRARAATPGEQVSLTELGRVLLHINQKRGYKHAKADEAAEAETKKGKETGYVAQVKGRYQILKEKGLTIGQHFAGELRANQQTAPRGTYYTYRIKEQVYPRVRGV

SEQ ID NO: 603 - protein, 1009 aa, Porphyromonas catoniae
MRIIREAYIEEYDRIMAVQRVFYPELLTDALIGRIRDRIIFYQRPLKSCKQLVSFCEFEKKEKVIRVKHTNKEGVQELVEKTITIGPKVAPKSSPIFQVCKVWESIHNIRLYHPDGTERKLEQEEKQKLFDYLQRNDKLSLTTLRKELKIKPKDKLWCDKLLEKGIAGNTTAAILRKAFKGYEHYERLFRFDLVRRDSHEADEDGVIRPIIDESYQNEPLYKLWHILYSIEDRAEMRSALIGQLGIKAEDLDNGLMDALYKIDFVKQGYGNKSAKFICKLLPHLQEGKMYSEAAEAAGMRHSDSMTAQERDERNLLEEIPLLQKNALRQPVVEKVLNQMINLVNALKREHGEIDEVRVELARELKMSREEREKATKNNSSREKENKAIAERITEYGLTPTKSRIQKYRLWQESAESCIYCGKRVDVVQFLRGEETEVEHIIPKSILFDDSLSNKACACRSCNQEKGNRFAMEYIQAKGWEQDYIERVDSLFHDKKISYSKRQHLLMLPKDLPEDFIERHLRLSQYISREAQGILRKGIRLVSASEGGVTAKLRQLWGYDNILRDLNLERYKSMGETEVVTVEHRDGQRTDERIKDWSKRKDHRHHAIDALVVACTRQSYIQRLNRVNAEADRQEMDAFIKEQQQEHKLSKKEKLSLLENWLKEQPHFTTGEVKEHAEGILISFRPGKRTVSRGRNIYKRSGKTDVQRNVLIPRGALSEETVYGVISVDGENKVVCKYPLQKFLDTKETNVDKIADQAAEKIVDKVLREKIRERIKRYGKKEAFAEPLYLDEAQTQVVRSVRCFISKDQAKLIPLRYNDESEAVGFVAPGNNHHLALYRDASGKMRASVVSFFAAVERARYGIPMIVLNPRETREKARIIPDLPESIFSKLPEEDWVLEETLQEGEMVLLGMENDAIEEAIKKKDYSKLSRYLYRVQSLSYNDYKFCFHLETESEKKEKKKGEDKKRGEKAKNTAVMPPKRYRIRCLATYQEDLNPRKVKIDLLGRISLA

SEQ ID NO: 604 - protein, 1197 aa, Porphyromonas sp.
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 605 - protein, 1422 aa, Prevotella denticola
MTQKVLGLDLGTNSIGSSVRNLDLSDDLKGQLEFFSSDIFRSSVNKESNGREYSLAAQRSAHSRSRGLNEARRRKLWATLDLLIKYGFCPMSPESLMRWRTYDKQRGLFREYPIDDKNFNAWILLDFDGDGKPDYSSPYQLRRELVIRQFDFDQPIERYKLGRALYHIAQHRGFKSSKGETLSQQETNSKQSLTDDTADVAGEMKASEEKLSKGLSTYMKENNLLTVGAAFAQLEDEGVRVRNNNDYRAIRSQFQREIETIFKFQQGLSVENELYERLVSEKKNIGTIFYKRPLRSQRGNVGKCTLERTKPRCAIGHPLFEKFRAWTLINNIKVRMSEEEQAEQLPMKLRFELYNDCFLAFVRAEFKFEDIRKYLEKRLGVHFSYNDKTINYKDSTSVAGCPITARFRKLLGEDWESFHVDGQKQRQAHGKNNASFHTVSYSTNDIWHFCYDAEEPEAVLSFAQDNLKWEKKKAEELVRIWSAIPQGYAMLSQKAIRNINKMLILGLKYSDAVLLAKVPEIVEITDGEILSVTEDYHRVEAQVGYEKQINNIVNALIAKYKSASEEYRFADHNYEYQLDKSDEKDIIKQIESNIGTRKWSLLDADEQTDILQKVRDKYQNFFRSHERKFVESPKLGECFEEYLMKKFPMVEGERWKKLYHPSQIAIYRPVPANKDRSALRLGNPDIGAIKNPTVLRVLNTLRKRVNQLLDDGIISPDETRVVVETARELNDANRKWALDTYNRIRHDENEKIKKILAEFYPKRDNISTVDIDKARYVIDQREMDYFTEAKTYHKDIKKYKLWLEQGGQCMYTGRTINLSNLFDPNSFDVEHTIPESISFDSSDMNLTLCDAHYNRFIKKNHIPADLPNYDKSVVIDGKEYSPIKPRLQRWADRVERLNRNVEYWRGQARRAQNKDRKDQCMREMHLWKMELEYWTKKLERFTITEVTDEFKNSQLVDTRVITRHAVLYLKSIFPHVDVQRGDVTAKFRKILGIQSVDEKKDRSLHSHHAIDATTLTIIPGAAKRERMLELFAKIEEVNKMLSFSGNEDRTGLKQELDGLKNQLNKEVKACRIGHNVSEIGTFINDNIIINHHVKNQALTPVRRRLRKRGHIVGGMDNPRWQTGDALRGEIHKASYYGAITQYAKDKEGKVLMKEGRPQINPTIKFVIRRELKYKKSSTDSGFASWDDLGKAIVDKELFALMKGQFPEGTSFKDACEQGIYMIKKGKNGEVDTKLYRIRHIRCKTKQKNALKIKEQAYKSEKEYKRYFYAAVGDLYAMCCYTNGKTREFKIYSLYDISCHRKVGVEDIPEFITDKKGNRLMLDYKLHTGDMILLYKENPEELYDLDNVSLSKLLYKINGFENDGLRIRMVNHLVAKEAMGESVKDYAKLPDIIRCGVKTIKFLVMGENRDFVIKNGKISFNHR

SEQ ID NO: 606 - protein, 443 aa, Prevotella disiens
MELDYWKGKYNRFTMTEIPEGFSRRQGMGIGLISRYAGLYLKTIFHKKDNPQKSNVYIVKGSITAEFRRIWNIQDDYEKKCRDNHIHHCIDAIVVGCIGKREYDLMAQFYRDEEKYRWEKKKKPFFKKPWETFTQDMLSLKDEVLTVHFNPSNFTKKAHKKVFTPKGIFVAQGDCARVKLHKESYFGAIEQKGEIKYVMRKELSALKIEDIKNIVDAVVKEKVLAVVKKKGFKQAMAEPIYMNEDKRILIKKVRLFVSQTNPLIVKKHRDLSSKEYKQNYYVDNEGNLMIAMYEGVKKNGKIDREITVVNNLEAAKFFRQSQKNNAEKQLISHLSPKNGYPLKTVLTQKQLVLMYEDSPKEIKLRDTKNMVKRLYQVVEIEKDGRVKLKFHQEARSEGLNKNSAAFKIQDTPESLYRHTKSNLKVLVNGVDFKINILGEISLI

SEQ ID NO: 607 - protein, 1375 aa, Prevotella histicola
MKKILGLDLGTTSIGWALVYESENTDEKSSIVRLGVRVNPLSVDEKGNFEKGKAITTNADRQQTHGARINLQRYKLRRENLKDCLQKQGWIGTEALCEEGKTSTFETYMLRAKAAEEEISLHELCRVLFMMNKKRGYKSNRKANNKEDGKLFDGMTVAKKLYEEHLTPAEYSFQLLSSGKKFKQEYYRSDLKEEFDRIWNEQQKYYPEILTDDFKQQLQGKSKGNTSKIFLGKYGIYSADLKGLDRKLQPLKWRVEALKQQVDKEVLAFVISDLNGQIASTSGLLGAISDRSKELYFNKQTVGQYLWTSLKETPHVSIKNKPFYRQDYLDEFEKIWETQATYHKELTPELKQEIRDIIIFYQRPLKSKKGLISVCELEQRKVKVTIDGKEKEISIGPKVAPKSSPMFQEFRIWQNLNNILLIDKGNNSIHPLYEEEKNLLYEELSVKEKLSKAEALKVLNKNSKQWDLNYKEIEGNRTQAVLYDCYNRIIVMTGHEEYNFKKLKASEIRSYVKTTFTGLGFNTDILEFDSSLTGHELEKQPMYQLWHLLYSYESDNSRTGNDALLRKLETAFGFPKEYAAVLSDVVFEDSYGNLSVKAMRKILPHLQAGLNYSQACEEAGYKHSRRSLTKNELDQKEYKEKLELLPKNSLHNPVVEKILNQMINVINAVIDEYGKPDEIRIELARELKIGAAERENMTRSINQGNAENKRIREILEKEFALSYISRNDIIKYKLYEELKSNGFKTLYSDTYISKDKLFSKDFDIEHIIPKARLFDDSLSNKTIEARDVNIAKSNKTAFDFISEKYDQQGIEAYKKKLDILLQDGSISKAKYNRLLMKEADIPSGFIDRDLRDTQYIAKKAYEILSDLVRNVTPTTGAVTSRLREDWQLVDVMKELNFEKYQKLGLVEVIEDRDGRKIKRIKDWTKRNDHRHHAMDALTIAFTKPSYIQYLNNLNARSDKNSSIYGIENKELHREDNKLRFNAPLPINEFRAEARRHLKSILVSVKAKNKVMTQNVNVIKTKHGVIKKVQLTPRGELHNATFYGTKKRPIIKMVKVGAALDEVTIKKVSSSFIREALLDRLHEYNGDAKKAFTGRNSIDKNPIYIDEEHKKTVPALVKTIEWEMYHPTRKLISPDLKIDKVIDKGIREILKTRLAKFNGDAQKAFSNLDENPIYKDEAKKITLKRVSLEGVSSVIPLHTLKDREGKLVVGKDGKPVLGDYVQTSNNHHIAFYMDENGNLQDNVVSFFEAAERKSQGVPVIDKNYNHDKGWNFLFTMKQNEYFVFPNEVTGFNPSEVDLMDEANYSIISPNLYRVQKMSKASGRDYWFRHHLEAMLNDDPKLRNSMFKRITSLKALEGIVKVRINCIGKIVAVGEYD

SEQ ID NO: 608 - protein, 1380 aa, Prevotella intermedia
MKRILGLDLGTTSIGWALVNEAENNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKFQPLKWRVEALQQQVDKEVLAFVISDLKGQIANTSGLLGAISDRSKELYFNKQTVGQYLWASLEENPHISIKNKPFYRQDYLDEFEKIWETQAAFHKQLTPELKQEIRDIIIFYQRPLKSKKSLISVCELEQRKVKATIDGKEKEITIGPKVAPKSSPVFQEFRIWQNLNNVLLIDNDTNEKRPLDEVERNLLYKELSIKAKLSKTEALKILNKKGKQWDLNYRELEGNRTQAILFDCYNRIITLTGHEECDFKKIKASEIRHYVSTIFKNLGFSTEILDFDPSLKKHELEKQPMYQLWHLLYSYESDNSRTGNESLLRKLETTFGFPEEYATVLCDVVFEEDYGNLSVKAMREILPYLQAGNDYSQACAYAGYNHSRHSLTKEELDQKVYKERLELLPKNSLRNPVVEKILNQMINVINAIIDEYGKPDEIRIEMARELKSSAADRKKTTHAISQGNAENQRIREILEKEFSLSYISRNDIIKYKLYEELEPNYYKTLYSDTYITKDKLFSKDFDIEHIIPKARLFDDSFSNKTLEARNINLEKSNKTAFDFIKEKYGEDGAEAYKKKLDMLLENDAISRPKYNNLLRAEADIPSDFINRDLRNTQYIAKKACEILGELVKTVTPTTGKITNRLREDWQLVDVMKELNFEKYEKLGLTEIVEDRDGRKIKRIKDWTKRNDHRHHAMDALAIAFTKPSFIQYLNNLNARSNKGDSIYAIENKELHYEEGKLRFNAPIPVNEFRAEAKRHLSAILVSIKAKNKVMTQNVNKIKTKHGIIKKIQLTPRGPLHNETIYGTKMRPIIKMVKVGAALDEATINKVSSPAIREALLKRLNEYSGNAKKAFTGKNTLEKNPIYLNAGRTKTVPSLVKTVEWESFHPTRKLIDKDLNVDKVVDKGIREILKARLEEFNGDAKKAFSNLEENPIYLDEAKKIALKRVSIEGVLSAIPLHTLKNQAGKPITGKDGKPVLGNYVQTSNNHHIAFYYDEDGNLQDNAVSFFEAAERKSQGIPVIDKDYNRDKGWRFLFTMKQNEYFVFPNEATGFIPSEVDLTDEANYGIISPNLYRVQKVSRIDKGTSASRDYWFRHHLETILNDDAKLKNLAFKRIRGLLELKDIIKVRINSTGKIVAVGEYD

SEQ ID NO: 609 - protein, 129 aa, Prevotella multiformis
MQKGGTGCKINRQTVGNVEVNVLNLRLYDRTDDREVTAGYLPTKEDYVRLFVYLNDRKEINQDTLLKDYFRLKKVKCGNEKEFAIRWNYIEDKEKKYPCNETRHELLAALDRAGMEHGWLDDSGTSARW

SEQ ID NO: 610 - protein, 535 aa, Prevotella multiformis
MVKGLLSNIVRTAEEREETSKFVISCTGRITDRLKQDWGLNDVWNSLVYTRFKRLNELTETEAFGHWQDKDRRVFQTSVPLELQRGFSKKRIDHRHHAMDALVIACASRNIIGYLNNESAESPEKREDLRRKLCDKNHIIRKPWESFTQDARAALEDIVVSFKNYVRIINKATNYYERYDADGRKTKAEQKGGEMWAVRKPMHEATYYGKVNLRRKERVSLKAALEDIPSICNRDLRDYINGLVEKHFNKEQVLAQFRSVGNRWNKQHIDKVDVWRFSDGKEEMVATRKPLDTSFDAKRIEAVTDTGIQRILSNYLEAKGGDPKIAFTPEGIADMNQHITAYNNGKQHKPILKVRVSTKLGKKYPVGQTGCKAGQFVVAEAGTNLYFAVYEDGEGNRSYDTIPLNEAVECLKQGLPPVPETREKGDRLKFYLSPNDLVYVPAGDEENEIDRERIYKFVDSSGTTANFIPHRTAGLIYNVDKKLAEALCNGSIIQNEYGVGSQQSKNQKALTGEMVKAVCWKLEVDRLGNILRIIK

SEQ ID NO: 611 - protein, 1380 aa, Prevotella nigrescens
MKRILGLDLGTTSIGWALVNEAESNNEASSIVRLGVRVNPLTVDEKSNFEKGKAITTNADRQLRHGARINLQRYKLRRQNLHDCLQKQGWLGTEAMYEEGKASTFETYKLRAKAAEEEISLHEFARVLFMLNKKRGYKSNRKANNKEDGQLFDGMTIAKKLYEEHLTPAEYSLQLLNKGKKFTQGYYRSDLNAELERIWDEQKKYYPEILTDEFKQQLEGKTKTNTSKIFLAKYGIYSADLKGLDRKLQPLKWRVEALKQQVDKEVLAFVISDLKGQIANTSGLLGAISDRSKELYFNKQTVGQYLWASLEENPHISIKNKPFYRQDYLDEFEKIWETQATFHKQLTPELKQEIRDIIIFYQRPLKSKKSLISVCELEQRKVKATIDGKEKEITIGPKVAPKSSPVFQEFRIWQNLNNVLLIDNDTNEKRPLDEDERYLLYKELSIKAKLSKTEALKILNKKGKQWDLNYKELEGNRTQAILFDCYNRIITLTGHEECDFKKIKASEIRHYVSTIFKNLGFSTEILDFDPSLEKHELEKQPMYQLWHLLYSYESDNSRTGNESLLRKLETTFGFPEEYATVLCDVVFEEDYGNLSVKAMRKILPYLQAGNDYSQACAYAGYNHSRHSLTKEELDQKVYKERLELLPKNSLRNPVVEKILNQMINVINAIIDEYGKPDEIRIEMARELKSSAADRKKTTHAINQGNDENQCIREILEKEFALSYISRNDIIKYKLYEELKPNGFKTLYSDTYIPKDKLFSKDFDIEHIIPKARLFDDSYSNKTLEARDINLAKSNKTAFDFVKEKYGEQGAEAYKKKLDMLLGNNVISKPKYNKLLMTEADIPSDFINRDLRNTQYIARKACEILGELVRTVTPTTGKITNRLREDWQLVDVMKELNFEKYEKLGLTEIVEDRDGRKIKRIKDWTKRNDHRHHAMDALAIAFTKPSYIQYLNNLNARSNKGDSIYAIENKELHYEEGKLRFNAPIPVNVFRAEAKRHLSAILVSIKAKNKVMTQNVNKIKTKHGIIKKIQLTPRGPLHNETIYGTKMRPIIKKVKVGAALDEATINKVSSPAIREVLLKRLNEYSGNAKKAFTGKNTLDKNPIYLNAERTKTVPASVKTVEWENYHPIRKPITPDLKVDKVIDKGIGEILKARLEEFNGDAKKAFSNLEENPIYLDQTKKIALKRVSIEGVLSTIPLHTLKNQAGKPIMGKDGKPVLGNYVQTSNNHHIAFYYDEDGNLQDNAVSFFEAAERKSQGISVIDKDYNRDKGWRFLFTMKQNEYFVFPNEATGFIPSEVDLTDEANYGIISPNLYRVQKMSRIEKGTSVSRDYWFRHHLETILNDDSRLKNSAFKRINSLKPLEGIIKVRINSIGKIVAVGEYD

SEQ ID NO: 612 - protein, 1506 aa, Prevotella nigrescens
MKTILGLDLGPNSIGWAKVEVDDEGNYLRNIKLGSRIIPMTQDMLGDFDKGVKVSQTAIRTDFRGNRRLIERHLLRRERLHRVLHALKFLPKHYEDAIGWDRNEPATYGKFVNNSEPKLAWERQEDGSMRFLFMESFNEMVADFAQNQPSLVSDGKKIPLDWTIYYLRKKALTRPIKKEELAWILLNFNQKRGYYQLRGEEEEDNLTKRKEYYKLKVVGVEADGAPKGGKTWYNIHLENGWTARCQSKIPLDDWVGKVKEYIVTTEYEDDGKTPKCDKEGKVKRSFKSPEKDDWQLIKTRTEKFIDDSNKTVGAFIYDYLLEKPFDKIRGKYIRTIERKYYKNELREILREQTKYHEGLHSLEALKICAEELYKNNQQHQEYLLKKDMTFLLLNDLIFYQRPLKSKKSLIADCPYEVYKYDDKLTGKKGQKKIKCIAKSNPYYQEFRLWQFIANLRLFSVTDGKEVTAEYLKTEEDYVRLFSFLNDRKDIKQETFLRSFLKLKKESIGSEKIYPIRWNYIEDANKSYPCNATRHELLLAFDRADIPRELLDVEEREYRLWHLLYSIEAKEETESALRKLKANKAFGDLNIDDAFVNSFLKIKPFEKEYGAYSEKAIKKLLAVMRRGSLWKEADICEATKQNIAKILQNDIDEKLKKKIEAAVSSFNKLSDFQGLPTWLACYVVYGRHSEAAQIQCWQSPEDLKTYINKFKQHSLRNPIVEQCLLETLRTVYDIWKDAGQIDEIHIELGRNMKSTAEQRARKTKDILRNENTNLRIKNLLVELKNDDKIENVRPYSPSQQEILRIYEEGALQELSKEDEMFEDISKISKMAQPSPTELSRYKLWLEQKYRSPYTGRVIPLSKLFTTAYQIEHIIPQSRYFDDSFNNKVICESEVNSLKDNMLGYEFIKECGGRIVHCTLLGDVKIFTKEEYKDFVTKHYIDNTYKRDKLLLEDIPQEFSARQLNDSRYISKMVQTVLSNIVRAENEQEATSKFVVSCNGAITNRLKKDWGLNDVWSSIVCPRFKRLNEITKTNAFGHWEDKAGKHVFQTTVPLELQRGFSKKRIDHRHHAMDALVIACASRNIVNYLNNESANSPEKREDLRKKLCDEKRKIRKPWKTFTQDAREALSDVVVSFKNYVRVINKATNYYEHYSSSGNKVMISQKGNDMWAIRKPLHKESVFGRVNLCRKVIVSLKKALENIPAICDKTLRDYINALVEKHFNTRQLLAHFKSINYRLNRQCVEKVEVWQFSDEKIEMVARRKSLDTSFDDKQISSITDTGIQKILLNYLQTKDGNAEIAFTPEGIEEMNKNISLYNDGKAHQPILKVRVATPKGMKYPVGQTGNKATKFVVAEKGTNLYFAIYENELGVRSYDTIPLNIVVERLKEGLSPVPQANEADIPLKFYLSPNDLVYVPTKENEDELCRDRIYKFVDSSGTTANFVPHTSANTIYNVDKEYAEKCCNGAVFLNEYGLGSPQSKNQRALTGEMIKEICWKLKVDRLGNIIKVIK

SEQ ID NO: 613 - protein, 774 aa, Prevotella oulorum
MEQCILETLRTVYDIWKEAGQIDEIHVELGREMKQTAEQRAHLTEKVLRNENTNLRIKSLLMELKNDADMKDVRPYSPMQQEILRIYEEGALQTLSKDDAAFTEIMKISKMAQPSASELQRYRLWLEQKYRSPYTGKPISLSKLFTSAYQIEHIIPKKRYFDDSFSNKVICEAEVNGKKDSMLAYEFIKDCGGDVIHCTTLGDVTILSEAEYKALVTELYANNKSKKDKLLMEDIPQDFINRQLNDSRYISRVVMTLLSNIVRIEGEEEATSKFVIPCSGGITDKLKKDWGLNDVWNNIVYPRFERLNALTNTSDFGQWENKEGKRVFQTSVPLELQRGYQKKRIDHRHHAMDALVIACASRKIINYLNNQEANDPTKQENARKQLCIKSRIIRKPWETFTQDAYKALDNIVVSFKNYVRVINKATNYYERYNADGKKAVDEQKGEAMWAIRKPMHKDTVFGHVNLRRKAVVKLKDALENIPAICDKTLRHYIQDLQKKHFNTKQLLAHFKSINYRLNKQAVDKVEVWQYSDDKEQLAATRKPLGPSFDAKCIAAITDTGIQKILLNYLQAKGGDPAIAFTPEGIAEMNQNIAVYNGGKQHQPILKVRIAKPMGKKFPIGQTGNKAFQYVIAEEGTNLYFAIYEDEEGNRTYDTIALREVVERLKQGLTPVPEKNEKGVALKFHLSPNDLVYVPTADELLSKVCSLDKNRIYKMVSATKSECLFIPHSVAKTIYDKVEFEALNKMGRALTGEMIKSVCWKIEVDRLGHIVNIIK

SEQ ID NO: 614 - protein, 691 aa, Prevotella oulorum
MKTILGLDLGTNSIGWAKVIVDDNENYLRDIQLGSRIIPMSQDVLGKFDKGVTESQTAIRTSFRGVRRLRERTLQRRERLHRVLHTLHYLPPHYDSAIGWDRKTPTTYGKFLNHGEPKLAWERREDGTMQFLFMDAFHEMIADFAKYQPALVADGKKVPLDWTIYYLRKKALTQPIKKEELAWILLNFNQKRGYYQLRGEEDEENAAKHEEYHELKVVGVEVDEAGKGDNTWYNVKLENGWTYHRQSKIPLDDWVGKVRAFIVTTEYEKDGTTPKKDKEGNVKRSFRSPDEKDWGLRKKQTEHSLEASGTPVGAFIYDHLLKEPSDKIRGKFIHTIERKYYKQELAAILREQSKHHEKLCSKDMLKACIEELYPNNPLHRESLLKKDMPYLLIEDLIFYQRPLKSKKSLIAECPYEAYSYVDKETGEMKRQGIKCIAKSNPYYQEFRLWQLIANLRLRNRSDERDVTAEYLPHQEDYVRLFTYLNDRKEINQETLLKDFFKLKKVTIGGEKVFPIRWDYIEDKEKKYPCNATRHELLLALDRAGIEHDWLNDRDLAYRLWHLLYSVDSKDETERALRKLKDDDAFVESFLKIKPFEKEYGAYSEKAIKKLLPVMRRGSLWNEADLCPSTKERIANILQGTIDEKLKKKIGAFISSCQQVSDFQGLPEWLACYVVYGRHSEATDIQRWETPE

SEQ ID NO: 615 - protein, 242 aa, Prevotella saccharolytica
MKLVLGLDLGVGSVGWALIFITDSGEPIKILALGERIVSMDSNNSNEFSAGATCTLNQKKTKAKSVRKGYSRYVQRRDALTAELRHIGMMPDETLIKLPVLDLWQLRANAATEGKKLSLAEIGRVLYHINQRRGYKHGKSDVSSDNKQKGYVKAVNERYCMIQERQQTIGQYFALKLKETAVTTEKGTFYTFRIKDQVFPREAYEEEFVVAYSTKVLKFKQITTLLNVVICLMMLLLIVQRY

SEQ ID NO: 616 - protein, 1174 aa, Prevotella sp.
MEFHPELCDAELLKACAEELYRNNEAHRAQLLAKDFKHLLVEDVLFYQRPLKSKKSLIANCPYETRQYINKETGEIKDVNVKCIAKSNPYFQEFRLWQWISNLRLLRQADGQDVTAAYIKGNEDKERLFDLLNNQGEIKQEHILRDFLKLKKPKGGEFPLRWNYVDDKIYPANETRHAINKAIKGMAVDKEEKETLGQLLDQPAVAYMLWNLLYSITDRNELARALRRFALTHGVSSVDAFVESFLKVKPFKKEYGAYSEKATKKLLQVMRLGKYWCGDELPEPAKRTKGNKQAVYDEMAHRGICKQTLQNISNIIEENIDERLMGALLNPERPLTELSHFQGLSVSDACYVVYGRHSEVAEIVKWKDADELNTFINNFKQHSMRNPIVEQCVLETLRTVRDVWEQEGQIDEIHVELGRNMKRTAEQRARDTQAIQRNENTNMRISLLLTELKNDPSISDVRPYSPSQRELLKIYEEGALENLTNQDEDIAKISRLAQPSASELRRYKLWLDQKYVSPYTGRPIPLAKLFTPAYEIEHIIPQSRYFDNSFSNKVICEAEVNKLKDNLLGMEFIKKFGGKTKGILDEEAYKLHVTTNYAHNPAKRSKLLMEDLPTDFNSRQLNDTRYISKTVMALLSNVVREEGERETRSKHVVVCTGGVTDTLKKDWGLHDVWHNLVYPRFIRLNNLTGSQNFGYWRYLNEENSKKGEDSKKVFQITLPPECQRGFVKKRIDHRHHAMDALVIACASANIVNYLNNQSAANPHIHENLQRLLCDRKREIRKPWPTFTQDAQAALKDLVVSFKNTVRVVNKASNTYLRYDKDGKKKRFKQEGEGLKAIRKPMHKETYYGEVNLIRKEMVPLKRALDDVNAIVDKELRASIKGLLRDGFNPQQVLANFKAKDFKFDKRDIKKVEVYVSSEKSTPMVATRKSLDTSFNAKRIADITDTGIQKILLNYLKANDNSPEQAFTPEGIAYLNEHIAEYNDGKPHQPILKVRVSEVKGAKFAVGQTGSKKDKFVEAQSGTNLYFAIYEDKEGKRHFETIALKVAAERLKDKQMPVPEINDAGLPLKFYLSPNDLVYVPTDEDRATAHPSIDKMRIYKMVSATDRQCFFLPFTVASVISNKVEFEALNKMERVLDASEYSSAYDSSHVNKVMVKNVCWKLEVDRLGNITKIVR

SEQ ID NO: 617 - protein, 992 aa, Prevotella sp.
MITRILGLDTGTNSLAWAVVDRDANGNYTLVKRGDVIFTEGVKIEKGIESSKAAERTAHKALRVHYSRRRLHKIDTLKVLVELNLCPCLSDEQLSQWKAKKTYPLTDDFMLWQRSGSAEENNPYYCRHRCLTQKLDLTDQSQRFLLGRAFYHLAQRRGFLSNRLDTSADSDESGKVKSGIAQLSVEMEKAGCEFLGEYFYQLYKQHGNTIKLRSRYTDREEHYKKEFLAICEKQELDPKWVEALQRAIYFQRPLKSQRKGVGKCTFEPKKPRCAESHPDYEAFRMLCFLNNVKIQTPNDTSLRPLNEDEREKIWPIFFRKSKPNFDFEDIAKALAGKNNYAWYKDAGEKPFKFNYRMQQGVSGCPVTAQLIDIFGSDWQTAIAETYTAVEKKNGTKTIDEMADDVWNVLYSFSSKDKLKAFATEKLQLDEASATKFANAKLPHGFASLSLKAIRNILPFLRQGFIYAHAVHLAKIPDIVTKAVWNDADKREMILSGLMEIIENYNPKDRGVEGTIDFCIKSHLQDVIDLRPGAADALYHPSMIETYPDAKLNKMGVFQLGSPRTNAIRNPMAMRSLHILRSVVNQLLRDGIIDRDTEVHVEYARELNDANKRKAIADYQREQEKKRKQYRDDIIALYKSECHKEIEPTDTDILKFQLWEEQNHLCLYTGTQIGICDFLGDNPKFDIEHTVPRSVGGDSTQMNLTLCDATFNRQVKGAQLPSQLSNHADILVRIDHWKSKCEDLRKQLDKIRTYGGMEKNMKDRLIQKRHRLKMDLDYWQGKYSRFTMTEVPEGFSRRQGAGIGLVSKYAGLFLKSLFHNEQNPNKSNVYVVKGVTTAEFRRMWGLQGEYEKKSRLNHCHHCIDAITIACIGKAEYDKMAQYYHDEELFQWRGTTTKPHFNKPWPTFTEDVLAIEQSLLVKHLTKDNMPKQAKKRVRTATGKYLAQGDTARGSLHKDTYYGAIEQNGEIRYVLRKPLNKFENEAELEKIVDQA

SEQ ID NO: 618 - protein, 1375 aa, Prevotella sp.
MKKILGLDLGTTSIGWALVNESENKDEQSSIVRLGVRVIPLTVDEKGNFEKGKAITTNADRQQVHAARINLQRYKLRRENLRDCLQKQGWIGSEPMCEDGKSSTFETYKLRAKAAVEEVSLHEFARVLFMLNKKRGYKSNRKANDKEEGKLFDGMTIAKKLYEEHLTPAEYSLQLLNTGRKFTPEYYRSDLIEEFEKIWNEQQKYYPEILTDEFKQQLEGKAKSNTSKLFLGKYGIYSADTKGLDRRLQPLKWRVEAMKQQVDKDVLAFVISDLKGQIANTSGLLGAISDRSKELYFSKQTIGQYLWASLQENPHISIKNQPFYRQDYLDEFEKIWETQATYHKELTSELKQEIRDIIIFYQRPLKSKKNLIAVCELEQRKVKVTVDGKEKEITIGPKIAPKSSPMFQEFRIWQNLNNILLLDHETNSKRPLYEEERNLLYEELSVKEKLSKTEALKVLGKKSKQWDLNYKELEGNRTQAVLYDCYNRIIVMSGHEECNFKKLKASDIRHYVKMIFKNLAFNTDILCFDSSLKGHELERQPMCQLWHLLYSYEGDNSRTGNDALLRKLETSFGFPKEYAAVLADVIFEDSYGNLSVKAMRNILPHLQAGKDYSQACEEAGYKHSRRSLTKEELNQKVYKEKLELLPKNSLHNPVVEKILNQMVNVINAVIEEYGKPDEIRIELARDLKIGAAERENMTRSINQGNAENKRIREILEKEFALSYLSRNDIIKYKLYEELKSNGFKTLYSDTYISKDKLFSKDFDIEHIIPKARLFDDSLSNKTIEARDVNIAKSNKTAFDFILERYGEQGVKTYKTKLLRLLEDGAISNKKYNNLLKTEADIPSGFIDRDLRNTQYIAKKAYEILSELVKIVTPTTGSVTNRLREDWQLVDVMKELNFEKYQKLGLADVIEDRDGRKVKRIKDWTKRNDHRHHAMDALTIAFTKPSYIQYLNNLNARSDKSSSIYGIEVKELHREEGKFRFNAPLPINEFRAEAKRHLKSVLVSIKAKKKVMTQNVNKIKTKHGIIKKVQLTPRGELHNATYYGTKKRPLVRMVKVGAALDEATIKRVCSPAIRAALLKRLNAYNGDAKEAFTGRNSIDKNPIYLDIEQTKLVPVLVKTIEWGMYHPIRKRITPDLKIDKVIDKGIREKLKARLAEFNGDAQKAFSNLDENPIYMDEAKRITLKRVSIEGVLSAIPLHTLKDKAGKPVIGSDGKPVFGDYVQTSNNHHIAFYIDDKGNLQDNPVSFFEAAERKSQGVPVIDRRYNCDKGWHFVFTMKQNEYFVFPNEATGFIPSEVDLLDEANYCIISPNLYRVQKLSKASGRDYWFRHHLETMLNDDLRLKNSTFKRIQSLKGLEDIVKVRINSIGKIVAVGKYD

SEQ ID NO: 619 - protein, 1483 aa, Prevotella sp.
MKTILGLDLGTNSIGWAKVSVDDYGNYLHDIKLGSRIIPMSQDVLGNFDSGVTVSQTAQRTEFRSKRRLVQRNLQRRERLHRVLHVLDFLPAHYDAAIGWDRTEAVTYGKFLNHAEPKLAWEELGNGKRRFLFMDSFHEMVADFARCQPALVADGKKIPLDWTIYYLRKKALTQAITKEELAWILLNFNQKRGYYQLRGEEEEENPTKQEEYYELKVVSVEATDSRKGNDTWYNVHLENGWIYRRSSKISLDDWVGKVKQFIVTTEYEKDGTTLKTDKEGNVKRSFRAPNENDWGLRKKRTETLLEMSGKTVGAFIYDHLLQEPADKIRGNFIRTIERHYYKAELEAILAEQCKYHIELRDKEMLEACARELYLNNLPHQRSLMKKDMTYLLLYDLIFYQRPLKSKKALIANCPYEYYEYVDKETGEIKRQNIKCIAKSNPYFQEFRLWQFVLNLRLFDRVEDKEVTANYLPTADDHARLFTYLNDRKEINQETLLKDYFKLKKVKIGNEKEYPIRWNYIEDKEKKYPCNETRYELLMALDRAGIEHKWLDDNNLEYRLWHLLYSVEVKSESETALRKLKNDDAFVNSFLKVKPFKKEYGAYSEKAIKRLLAVMRKGFLWNEQDICDETRKRIEIIIKGDVDEKVKERMGHAAYSFDRVSDFQGLPEWLACYVVYGRHSEAMDIQRWDSPERLMAYINNFKQYSLRNPIVEQCILETLRTVHDIWKETGQIDEIHVELGREMKSTSEERARRTQNVLRNENTNLRIKSLLIELKNDTDICNVHPYSPMQQEILRIYEEGALQELNREDEDFEEISKISQMSQPSGKELNRYKLWLEQKYRSPYTGKAISLAKLFTPAYQIEHVIPQSRYFDDSFTNKVICEAEVNTLKSNLLGYEFIKKHGGEIIHCTTLGDVRIFSESEYKAFVMDHYANNKSKKDKLLMEDIPQEFLSRQMNDSRYISKVVKTLLSNIVRMADESEATSKSVIVCTGGVTDRLKKDWGLNDVWNSIVYSRFERLNRLTGTEAFGHWENKDGKRVFQTSMPLELQRGFRKKRIDHRHHAMDALVIACASRNIVNYLNNESANNPKKREDLRRQLCDKNRVIRKPWETFTQDAYNALENVVVSFKNYVRVINKATNRYEHYDENGKKRFVQQKGSELWAIRKPMHKETYYGHVNLRRKELVTLQKALDDIPSICDKKLRDYISALVEKHFNKRQLLAHFKSTDYYWQKQYVNKVYVWTFSDDIKPLVATRKLLDTSFDAKRIGTITDTGIQKILRNYLEAKGGNATLAFTPEGIVEMNQNISKYNDGKPHQPILKVRITEPMGAKYRVGQTENKMAKYVEAQSGTNLYFAIYEDSEGKRSYTTVPLDEVAERLKQRLSPVPEKDENDVPLKFYLSPNDLVYVPTEEELQLRECKLNKDRIYKMVSSTGSECHFIPYYVANVIYNKVEFEAKNKIGRALTGEMIKAVCWKLEIDRLGNILKVIK

SEQ ID NO: 620 - protein, 593 aa, Prevotella sp.
MNTRILGLDTGTNSLAWAVVDRDAKGNYTLVRRGDVIFTEGVNVDGQPVPSKAAVKSKYKSLRVQYARRRLRKIDTLKVLVSLDLCPYLSDQQLSQWKAKKTYPLTDDFMLWQRSGSAEENNPYYCRYRCLTQKLDLTDQSQRFLLGRAFYHLAQRRGFLSNRLDTTSDSAESGKVKSGIAQLSVEMEKAGCTFLGEYFYQLYKQHGNTVRLRSRYTDREEHYIKEFLAICEKQELDAQWVEKLQRALYFQRPLKSQRKGVGKCTFEPKKPRCAESHPDYEAFRMLCILNNIKIKTPKDVSLRPLNAEEREKVWPLFFRKSKPNFDFEDIAKALAGKNNYAWYKDAGEKPFRFNYRMHQGVSGCPVTAQLIDIFGSDWKAGIAETYTAVGKKNGTKTIDEMADDVWNVLYSFSSKDKLKAFATDKLQLDEARATKFANAKLPHGFAALSLKAIRNILPFLRQGFIYAHAVLLAKIPDIVTAAVWDDADKREQILSGLLEVIENYNPDDRGIEGTIDFCIKSHLQDVVDLRPGAADALYHPSMIEAYPDAKLNKMGVFQLGSPRTNAIRNPMAMRSLHILRSVVNLLLRDGMLS

SEQ ID NO: 621 - protein, 1424 aa, Prevotella sp.
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 622 - protein, 241 aa, Prevotella sp.
QAVKEKIKEAIAGKNFKTAIAEPIFMNKEKGIRINKVRYYVKAQERLKIRQQRDLSSKEYKQFFCVENESNYLLAIYEGELKGKKERDFCVVNNLDSAACLKRSNKGKAAPLVPERSEERNLPLLAVLKRGTQVLFYENSPEEILFDNPQDLVRRLYKVTGINTKKDVKNGKTYLYGNIELRFHQNAQKKDDVKMQSGVYKNNEVLRQGIVLSHKQFKALVEGVDFEFNVLGEIKKKERHA

SEQ ID NO: 623 - protein, 1216 aa, Prevotella stercorea
MTKILGIDTGTNSLGWAIVDKTADNYNLLDKGVNIFQEGVKIEKGIESSKAAERTEHRATRVRYYRIKLRKIRLLRILSDNHLCPPLSQEELSTWRLKKVYPKNELFMQWQRTDDDTEKTPYAYRHKCIHEKLDLSDVTDRYILGRAFYHIIQRRGFLSNRKEQGGEDSGKVKEGISTLTHEMNEAGYEYLGDYFYALYNKGEKIRKHYTARNEHFLSEFKAICEKQDLEKELGSEVVRNIEKAIFDQRPLKSQKGQVGKCVFEKNKTKCPSSHPMYEEFRMLTFINNIKIKTPNDDVLRPLNTGEREKIMPLFFRKSKKQFDFEDITKKLAPKKMYGFYKKEEDAEMPFLFNYPMDTSVSGCPVTAALKDVFGDDWITAICETYTLGEGKSRFDIVNDIWHALYFYSDKDKLAEFAINRLQLSEDEAKIFSEISLPADYASLSLKAICKILPYLRRGLIYSHAVFLGNLCEVMPKYEWSIKEMRETIIDNIIMEMDKCDTKDKRTFEVCIKDYLKGQYNVSDNSLKKLYHPSMIETYPRVQYTNEHGVYQLGSPRIDSVRNPMAMRSMFRLRKLVNRLLVEGKIDQNTEVHIEFARELNDANKRNAIALFVKENQSANDEARKQIITLFKKETGTDIEPTDKDILKYVLWEEQNHICLYTGKQIRISDFIGANPKFDIEHTIPRSVGGDSTKMNLTLCDSRFNREVKKTKLPVELPNHDEIMERIKEWKKNYELLDIQIRKNKKLSKGATTKEQKDTIIRKRHLLELRRDYWRGKYERFTMESVPEGFSRRQGTDISVISKYARLYLKSLFNRVYTVKGIATSDFRKIWGIQDIYSKKERINHVHHCIDAIVIACIGLDEYNKLGAYYHDEENNKWYGMSKASFKKPWATFVEDIKKIQDEILVYHYTPDNMPKQGRRRIKIDGKKILCKGDAARGSLHNDTYYGAIENDGAVKYVKRIDLASLEEKDVKNIVDDTVRSIIEAAIKEKGFKDAMASTIWMNEEKRVPIKKVRCFTPSITKPLNIRKQRDVSIKEYKQQYHVANDSNYLLALYIGTDNKGKEKREFEIVNILQAAQYYRTSNDKEVVDRHIVPIKSEHDYPFAYTLKIGTMVLLYEKSPNEVWDATIKERNRRLYKVTGLSTMRMKGRNGEYAYATVKLIHNEEARPSKDIKAKNGEYEQGEEFRPAIIMLHTQLNALVQGYDFEINELGEIRRLR

SEQ ID NO: 624 - protein, 1487 aa, Prevotella timonensis; identical to SEQ ID NO: 135

SEQ ID NO: 625 - protein, 770 aa, Pseudoramibacter alactolyticus
MAKGYFASDEEIDFSGVDDGFKNTLSSHQKFKEIFDVEVLNDWQKSMSEKIIFWATVYGDSKKFLKERLEDAYGNELDQKQIKRILGLRFKDWGRLSEAFLNLEGKNSKTNQSQTIIEALWNGDGTNNFNLMELLSSQFTYRDTLKKRALKGEKTLTNITYEDLSDLYLSPSVRRMVWQTILIVKELRQVLGAGPAKIFIEMARDVTLKAGTRTTSRRQQLLDLYKNVQTESRNWVEEIETQEESRFRSKKIFLYYTQMGQCMYTGEPIVFKDLFNRNLYDIDHIYPRHFVKDDSLINNLVLVKKQANSHKSDTFPIENSIQQARRDFWKWLSEKGLISREKFNRLTRRTSFSDEELAGFISRQIVETRQGTKAVAQIFENALPDSEVVYVKAGNVSDFRHHFNLLKCREINDLHHAQDAYLNVVVGNVYHTKFTKNPINFIKGYRKDRKAYAYHMDQIFDHPVKRNDIIAWQTDKNQSIATVKKVMAKGTPLVTRMSYEEHGELSNQNICSAKAAQKAEGKGYLPIKNSERLSNTQRYGGYNKYAGSYFFLVEHTLKKNRVRTIETMPLFLRDTIKTSKDLLKYCCESLKLEAPSIRVMKIKMGSLLSVNGAFVYLTGRSGKKLITPNGFQLILPQKWQDYIRLLIKTKDSPDDVEGISGGKNIEFYDILVEKHTKTCLKNRPNPIGEKLREWRNDFIALDNQKQSDILLEILKLTTFDNSGADLRAIGGKNQSGVSTIGKKISSQKSVVLVHRSVTGIFEKQVDLLSI

SEQ ID NO: 626 - protein, 103 aa, Rhizobium etli
MSGEQLTREIGRSGVKASAVGLGTWAIGGWMWGGTDEAQSIAAIQASLDAGVTLIDTAPAYGLGRSEEIVGKALAGRRDKAVIATKCGLVWHTQKGNHFFDQD

SEQ ID NO: 627 - protein, 1059 aa, Rhodovulum sp.
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 628 - protein, 1405 aa, Riemerella anatipestifer
MKTILGLDLGTNSIGWALVKEAENSNEKSEIIKLGVRVNPLTVDEKTNFEAGRPLSTNADRTAKRSARRNLQRYKLRRKNLIDLLIKNQLIDKDTPLTEIGKNTTHQTLELRAKAARERIELEDLARVFLAINKKRGYRSSRKVNNEEEGQAVDGMAVAKKLYDENLTPGQYAYELLSKGKKYVPDFYRSDLQAEFNAIWEYQKQFYADILDDELYNALKGQGQQNSRKRFLAIKGVYTAENKGKRDDVKLRHYKWRSEAISKKINIEEVAYVLVEINNDLNKSSGYLGAISDRSKELYFNKETVGENLWKQIQKNPHTSLKNQVFYRQDYLDEFEQIWETQAQFHPQLTLALKEQIRDVIIFYQRKLKSQKGLLSFCQFESWEIERKDENGNVILNKTTQLPKRQTVGRRVAPKSSPLFQEFKIWQNINNLEVTKISEGASKNKKETETLSDDERKLLFEELNLRGNLSQKEVLQILGLKDKEYKTNFSEGLEGNRTNAALFNIYQQIAENEGYGFDWSKKSAQEIKEELKAVFPQIGIQADILDFNANLDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRELLDKLELLPKNSLRNPVVEKILNQMVNVVNQVIETYGKPDEVRIELARELKKSAEKRAEMTKSINEATRRNEDIKKLITKDFGIPNPTKSDVVRYRLWEELAPLAYKDVFTGKQIKKEDLFSSKIDIEHIIPKALLFDDSFSNKTLVFRETNLKKADRTAYDFIESDYNATLDDYIQRVETLYNNTKGTISKGKRNKLLMAQKNLPDGFIERDLRNSQYIAKKAKAMLYQVFKDVNVTSGSITDRLREDWDLINVMKELNFPKYKALGLTEIEERYDIGQEKTKRVEVITDWTKRNDHRHHAMNALTVAFTTSSHIQYLNYLNARKNESHKEHKNIKGIENKITHKQKDKRKFIPPMPNFREEAKKHIETILVSIKNKNKVYTKNINKTKKKSGHNTKEQLTPRGQLHKETVYGKSKRPMSKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKKKGICIKRVTITGVSNAEALHHQKDHLGREILDDNGNPIPADFVSTGNNHHLAVYLDSEGKLQDNIVSFYEAVVRTSQGLPVVDKGLNKDLGWKFLFSLKQNEMFVFPNDDFDINDFDLLDDKKAELISKHLYRVQKISKVSAGNSFVRDIVFRHHLETTVKEVKELKDISYIQLKSLEGLRNIKKVRINHIGKIVQVGEY

SEQ ID NO: 629 - protein, 1145 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKCHYLKMVNL

SEQ ID NO: 630 - protein, 1400 aa, Riemerella anatipestifer
MKTILGLDLGTNSIGWALVKETENSNEKSEIIKLGVRVNPLTVDEKTNFEAGRPLSTNADRTAKRSARRNLQRYKLRRKNLIDLLIKHRLIDKDTPLTEIGKNTTHQTLELRAKAARERIELEDLARVFLAINKKRGYRSSRKVNNEEEGQVVDGMAVAKKLYDENLTPGQYAYELLSKGKKYVPDFYRSDLQAEFDSIWEYQKQFYADILDDELYNALKGQGQQNSRKRFLAIKGVYTAENKGKRDEVKLQHYKWRSEAITQKLSIEEVAYVLVEINNDLNKSSGYLGAISDRSKELYFNKETVGENLWKQIQKNPHTSLKNQVFYRQDYLDEFEQIWETQAQFHPQLTLALKEQIRDVVIFYQRKLKSQKGLLSFCQFESWEIERKDENGNVILNKTTQLPKRQTVGRRVAPKSSPLFQEFKIWQNINNLEIAKISDGNSKNKKETEALSDDERKLLFEELNLRGNLSQKEVLQILGLKDKEYKTNFPEGLEGNRTNAALFNIYQQIAENEGYGDWTKKSAQEIKEELKAVFPQIGIQADILDFNAELDGKEFENQASYQLWHLLYSAEEDDKINEEDQIIYGNSAVSLKKKLCEKFGFTPEYAKWIANVSLQDDYGNLSTKAMRKIIPYLIDGNDYSEACALAGYNHSNSLTKEENDNRERLNKLELLPKNSLRNPVVEKILNQMVNVVNQVIETYGKPDEVRIELARELKKSAEERAEMTKGINEATRRNEDIKKLITKNFGIPNPTKNDVVRYRLWEELAPLAYKDVFTGRQIKKEDLFSSKIDIEHIIPKALLFDDSFSNKTLAFRETNLKKADRTAYGFIESDYNATLDDYIQRVETLYNNAKGTISKGKRNKLLMAQKNLPDGFIERDLRNSQYIAKKAKSMIEKVFNDVNVTSGSITDRLREDWDLINVMKELNFPKYKALGLTEIEERYDIGQEKTKKVEVITDWTKRNDHRHHAMDALTVAFTTKSHVQYLNNLNTIHSLKGDEVDLELSKLYGLKNTITEVVNKKRKFIPPMPNFREEAKKHIETILVSIKNKNKVYTKNINKTKKESGYHTKEQLTPRGQLHKETVYGKSKRPMNKPTKINKNFSLEQAQLIINVQEKELVLRHLAQFDNNPAVAFDTKTLKKMPLLKNGEPLKEVLCFEEIFTIRKDITPDLKIEKVVDEKIKAILEQRKKDFGGNAKEAFSDLDKNPIWLNKEKGICIKRVTITGVSNAEALHHQKDHLGREILDDNGNPIPADFVSTGNNHHVAIYEDEKGKLQEKVVSLYEAVARANQGLPVVDKGLNEDLGWKFLFTMKQNEMFVFPNDDFDVNDIDLLDENNAKIISQHLFRVQKLATKNYMFRHHLETNVQEVKELNDIAYKSIRSTEPLKNIKKVRINHIGKIVQVGEY

SEQ ID NO: 631 - protein, 1128 aa, Roseburia intestinalis
MDEKMDYRIGLDIGIASVGWAVLQNNSDDEPVRIVDLGVRIFDTAEIPKTGESLAGPRRAARTTRRRLRRRKHRLDRIKWLFENQGLINIDDFLKRYNMAGLPDVYQLRYEALDRKLTDEELAQVLLHIAKHRGFRSTRKAETAAKENGAVLKATDENQKRMQEKGYRTVGEMIYLDEAFRIGCSWSEKGYILTPRNKAENYQHTMLRAMLVEEVKEIFSSQRRLGNKKATEELEEKYLEIMTSQRSFDLGPGMQPDGKPSPYAMEGFSDRVGKCTFLGDQGELRGAKGTYTAEYFVALQKINHTKLVNQDGETRNFTEEERRALTLLLFTQKEVKYAAVRKKLGLPEDILFYNLNYKKAATKEEQQKENQNTEKAKFIGMPYYHDYKKCLEERVKYLTENEVRDLFDEIGMILTCYKNDDSRTERLAKLGLVPIEMEGLLAYTPTKFQHLSMKAMRNIIPFLEKGMTYDKACEEAGYDFKADSKGTKQKLLTGENVNQTINEITNPVVKRSVSQTVKVINAIIRTYGSPQAINIELAREMSKTFEERRKIKGDMEKRQKNNEDVKKQIQELGKLSPTGQDILKYRLWQEQQGICMYSGKTIPLEELFKPGYDIDHILPYSITFDDSFRNKVLVTSQENRQKGNRTPYEYMGNDEQRWNEFETRVKTTIRDYKKQQKLLKKHFSEEERSEFKERNLTDTKYITTVIYNMIRQNLEMAPLNRPEKKKQVRAVNGAITAYLRKRWGLPQKNRETDTHHAMDAVVIACCTDGMIQKISRYTKVRERCYSKGTEFVDAETGEIFRPEDYSRAEWDEIFGVHIPKPWETFRAELDVRMGDDPKGFLDTHSDVALELDYPEYIYENLRPIFVSRMPNHKVTGAAHADTIRSPRHFKDEGIVLTKTALTDLKLDKDGEIDGYYNPQSDLLLYEALKKQLLLYGNDAKKAFAQDFHKPKADGTEGPVVRKVKIQKKQTMGVFVDSGNGIAENGGMVRIDVFRVNGKYYFVPVYTADVVKKVLPNRASTANKPYSEWRTMEDKDFLFSLYSRDLVHIKSKKGIPIKNVDGSLGESKEVYAYYIGADISGAKIEGKAHDSRYTFRGIGVQKLELIEKCQVDILGHISTVKNEKRMGFS

SEQ ID NO: 632 - protein, 1471 aa, Scardovia wiggsiae
MGYKAPRNDKGEIDYGVGLDLGNGSVGWVAMDKDYHLIRARGHELIGARLFDPANSAENRRESRTTRRRLSRRRWRLRMLDSLFASELAKIDPNFLARRKYSWVHPKDEQNHENWYGSIIFGSKEQDKQFYKDYPTIYHLRKKLTEDTERHDIREIYVAIHHIVKYRGHFLREGEINSENLFDPEGFVELIKDVIKLNNSYDESTPIFEASPADVSEALLNEHTSRSGRIEDTLDKLDFSVSRVDKHELKGMRDAAKAVIGAIVGNTADFSKIFNLDNLDKDSKDNLKLKFADSNFDEKYGGVVGSGLLDETQIELVDRIHAVYDAVALKGILGDAHTISEAKVESYEKHRKNWKLIKEELRTKENKDEVDLWYGDLSGRQYKNPPDPEKGPDEGSKKDSPIRDSDQKQNLIKKANDYFTELIDDSQLSEEQKNCLKNDINNGQLFPVQRSSDNGVIPYQIHLNELRRIIENQKQYYPFLAETFIRKTAEGKSYEENKIVALLKFRVPYYVGPLVSKEDMEEHSSGNSAYHWMARNPGRGEAITPWNFDEVVDKDESGARFISRLTGTDTYLLGEPTLPQHSLLYEEYMVLSELNNVRLNVRQGNHWSDKNRQRLSYKQKEFLIENLFKEHKTVTRKRAEDCLSSMGCGEVQLFGLSDEKKFASSLSSYITLKKILGKAFVDDSGNSAILERIIEVQTVFEDREPLTHQLSLIDSLTVEQRKQLAKIHYTGWGKLSRKLLTSKKGSYKIHSQNEIMRTQHSIIDIMRGDSLNLIEIIRDKKIGIGEWIDNENLDRETGESDVSRLESVFEGIVMSPRVKRGVVQAVRVIDDLAKAIGNPPQRIFIEMADEVQASQRTVSRLSRLKALYGSPSLQKEFNDLKDLRKSLNETKDADLQEDRLYLYYIQLGKDLYTGKEISIDSLSSAYDIDHIVPQALTQDDSIDNRVLVSRKENARKTDSYLYTPDLIKNMRPLWGKLLAAGLMSQKKYDALTRVDDFKDREKQRFVQRSLVETRQIMKNVSTILRTYYGEDTNVVTLKSSITHDMRKYLGFPYKNRDINDYHHAQDALCISAAGQFMLNRHFVSGGEVTDGASNAYNMYLAEYLQEFRDAKARGERKRSTAFGFVVGSMSSKDDEKRTDHRTGEIVWSETNAEYLRKVMNYKKMLITQKVGDVKTRALYDETRYGHKESSAKSIKFDNLRRDTSLYGGFSGASTAYMMLVEYKKKNKLVSITAQEASLLAVADQKNDTVSVMDGILASHGLSGAKILLPKIVTGQLLDYSDALVTLQSASELNTARQMWLPRNDYNDIDIILKSKDIEDAAHKLGYDSDTVHVLRRIQKLFEAVFRVAESQFPLHQLSKDQQEEILRDPQNYGFGSAVKLLGGLLKALHANAENTNLAGLVKVLHGDKEYSDDGKAKEFKKFGFSPRWRRISNPTGFTLSDSDTFIYQSPSGIFEQRVTVKELKEKADKQK

SEQ ID NO: 633 - protein, 116 aa, Sphingobacterium spiritivorum
MFRKYFEEKNSARLLFTLKQGDFVYVPDDNEEVILDESSPLFIDYWKNISERSNNIHVVQKFSGKEIYFLKHTIADTIAKKIEFGSQDCYQSLNGKSIKEFCIKIDSDRLGNISKV

SEQ ID NO: 634 - protein, 1306 aa, Sphingobacterium spiritivorum; identical to SEQ ID NO: 98

SEQ ID NO: 635 - protein, 1110 aa, Sphingobium sp.
MAEGKKRIWRLGADLGANSLGWAAIELSAPVNGKPIAILAAGSRIFSDGRDPKSGASLAVDRRDARAMRRRRDRFKQRQKALIKYLIADGLFPADEAARNAMAAIDPYAVRARALDEALSLPELGRALFHLNQRRGFKSNRKADRKADDDAGKIAIGIDRTRDAIAEDEADAGAEPGSWTFGKWLHERRLKGQSVRTRLRPESGEDAKGDGYDFYPDRALMEEEFDAIWAAQAPHHPDVLTNDVHDRLHEIIFYQRPLKAPQVGMCSLIPGDRRLPKAHPLFQRRRLLEELNALMIVRPGEVAQRLTREERDILLLKLKDKNKVSFATLRKALKLDPDARFNKESEDRTDLKGDEVAAVMGSKTRFGNLWVHLSIEAQWDVLARLDAVESDAEDAAFCAWLVETYALTPEQARAVANAPLPPGYGRFGETATRKLIEALRDGKKDDRVLVYSEAVTEAGLGHHSDRRTGEVFEDAKGRPQLPYYGVALERHIMPGTGDPSDPEEMRVGRLTNPTVHIGLNQLRRILNVLIRAYGPPAEIAIELARELKLTDEDKKRINRENNDNRIAAERRSEKLLAIGQADSGANRALLKLWEELNPANVLDRRCIYSGRQISIDMLFSAAVEVDHILPFAATLDDSNGNKIVCLREANREKRKRSPHDAWGHSARWDEIAARAAQLPRNKRWRFEPDAMDKFRDEGGFQARHLVDTQYLARLSREYLATLYPEKGEGSGHIWVSPGRLTEMVRRKLGLNDLLPDHNFGGGADQAKNRLDHRHHAIDAVVVAIVDRGMLNAIARASGQEGAEGRERIIIPEPWDGFRDALRETVNRITVSHRTDHGTASKAGLPKGKDATAGRLHNDTAYGFTGDTDAKGNSIVVRRVPLSSFKKLADLDRIRDADLKAALYQHLNGLEGKAFEKALAEFHKLEWHNFGGVRRVRVTEPLTVIPIKDRNGRIYKGYKGDSNYRYDVWELPDGKWVTNWKNEAGEAMSSVISMFDAHQSSEPPRPHPAARKILSLHQNDLLAIEREGEDRKLMRVVKFGQSGQITLAEHQQAGDLKKRDAVSNDDDPFKYFAPTSGGLKKVKARQVRIDEIGRVLDPGFPARTARRKTRG

SEQ ID NO: 636 - protein, 1084 aa, Sporolactobacillus vineae
MKYSIGLDIGISSVGWSVINLDRERIELMGARLFDAAENPKNGSSLAAPRRDARSARRRLRRRRYRVGRVRHFIIDRGLVTRGQADQLFDWKDGDLDIWLVRVNALERLLTDREFARVLIHIAKNRGYRSNRKSEAKSGENGQVLSAIKANKELMEEKGYQTVAEMLVNEPETFAGRKRNRGGEYTHVIARSELEHEIRLIFTKQRAFGNRFATEENENTYVKIWAAQRPVATKDDILKKIGDCTFEKGEKRAPKASYAFQYFRALDKLNRLRILSVREPSRNLTDDERNLIVPALFNHDKQKYSDLRKILQLRDDQKFNELFYDPGKSLKENENKTFLSLAEQYKIRKVIRDVQGKDGLLQYRPLDIDTIAYALTVFKDDQDTRDYLSNTFVNGNGKQVLNLANRAFDAELIDGLLSLSFAKFGHLSLKALHKLIPHMEQGLSYYDACKKVGYHDNEQVGKSKQHLLPVIPADEIRNPVVVRSLSQTRKVINAIIKRYGSPTFMYIELAREMGRPYNERRDLEKQYNKNRTVNDSAIEQIHELYPEIGAPRGHDILKYKLWQQQDCKCAYSLEKIPAEKIFEPGYAEVDHIIPYSRSFDDSNSNKVLVLSRMNQEKKNRTPYEWFGGDEHRWNKFESYVNALKVNRKKKSLLTKKNMDTEEEDTFKSRHLNDTRYITRFIKSFVEDNLLFREIEGAKQHVFTVNGAYTSLMRKRWGFNKNREESDLHHSVDAVIIAVSQPFRNEVSRYFKHREISLPQLLKRTWDYFPEPWEGFVKELRARTLQDPEKLKLALESLDLDSYDPEFIDEVKPIFISRMPKRSIKGQIHDETLRRNRGKTKDGFVKIVTRTRLENIKFDKNGDFPMYGRESDPKTYQAIKQRYLENNKDKKKAFIEPLYKPAKNPNNASLIRSVKIEDKANQIVPLRDEAVAYNASIVRTEVYRNKETGKFYLAPVYVSDVFAGREPRRFIRANVPYEQWVNITDKFTFLFNLYPNDVIYIKMKKVKTTKSNINKTISWQESYFYFKGTDIHTGAITIIDHMNSFTDRVGTQGLQLFEKYQVDPLGNLSRVHGETQYGVPALSHS

SEQ ID NO: 637 - protein, 475 aa, Staphylococcus massiliensis
MGQDYILGLDIGITSVGYGLIDYHDKSVIDAGVRLFKEANVENNEGRRSKRGSRRLQRRRKHRLARTRNLLESYQLNPFPKCEKNPYEIRVKGFKEVLTSDELSAALLHLAKRRGIDNVHVTDTESDSSDNGLSTKEQLAKNQKALESRYVCELQLERLLNDNKVRGANNRFKTQDFVREAKQILSIQKDHHNLDQVFIDKYISLLETRREYYEGPGKGSPYGWDGDIKKWYELLMGRCTYFPESLRSVKYAYSADLFNALNDLNNLVIVRDENDKLTYPEKYHIVENVFKQRKKPTLKQIAKEIDVAPEDIRGYRVTASGTPVFTSFKLYHDIKSVTSNDKVLEDTELLDAIAEVLTIYQSPIEVQEKLESLNVILTKEEIEGISKLTGYTGTHALSLKAIQIVIDELWETNDNQMTIFTRLNMKPQKVDLAKANKIPTSLVEDFIISPVAKRAFIQSIKVINAVIKNMVCLKI

SEQ ID NO: 638 - protein, 581 aa, Staphylococcus massiliensis
MPKDIIIELAREKNSDEERKIIRDVQKRNQQTRDLVDKVIKETGKTKAKGMVEKLILHDKQEGKCLYSLKSIPLEDLLNNPHHYEVDHIIPRSVSYDNSMNNKVLVLQEENSKKSNQTPFQYFNSSNTHITFKQFKQHVLNLSKTKDRITKKKKEYLLEERDINKFSVQKEFINRNLVDTRYATRELMTLLRAYFSANELDVKVKAINGGFTSYLRKRWDFKKDRNAGYKHHAEDALIIANVDFIFKQLKALDNAKKVMEGRKVQVEKDNVEDNEHYESLFREPDQIKEIKLYDNYKFSHRVDKKPNRELINDTIYSTRKVDNKTYTIQTVNNIYDKQNDQLKKLFNKSPEKFLMYKHDPKTFDKLATIMRQYKNEKNPLYKFHDETGEYLTKYAKKDNGPIVKSLKYIGKQVNAHLDITNDYENSNNKVVKLSLKPFRFDVYLDDGKYKFVTVKYLDIIKKDTYYVIDEEKYKLALQQKKISENAKFIGSFYNNDLIKINGELLRVIGVNDDAKNTLELNMIDISYRDYVENMNLATTPRIRKNIGKSITILEKYTTDILGNTFKISSPEKPQFIFKVRD

SEQ ID NO: 639 - protein, 1334 aa, Staphylococcus pseudintermedius; identical to SEQ ID NO: 205

SEQ ID NO: 640 - protein, 1112 aa, Staphylococcus simulans; identical to SEQ ID NO: 252

SEQ ID NO: 641 - protein, 773 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQ

SEQ ID NO: 642 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHVSYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 643 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKDYHEKFPTIYHLRKELADKKEKADLRLVYLALAHIIKFRGHFLIEDDRFDVRNTDIQKQYQAFLEIFDTSFENNHLLSQNVDVEAILTDKISKSAKKDRILAQYPNQKSTGIFAEFLKLIVGNQADFKKHFNLEDKTPLQFAKDSYDEDLENLLGQIGDEFADLFSAAKKLYDSVLLSGILTVTDLSTKAPLSAYMIQRYDEHREDLKQLKQFVKASLPEKYQEIFADSSKDGYAGYIEGKTNQEAFYKYLSKLLTKQEDSEYFLEKIKNEDFLRKQRTFDNGSIPHQVHLTELKAIIRRQSEYYPFLKENQDKIEKILTFRIPYYVGPLARGNSDFAWMTRKTDDSIRPWNFEDLVDKEKSAEAFIHRMTNNDLYLPEEKVLPKHSLIYEKFTVYNELTKVRYKNEQGETYFFDSNVKQEIFDGVFKEHRKVSKKQLLDFLAKEFEEFRIVDVTGLDKENKAFNASLGTYHDLKKILDKDFLDNPDNESILEDIVQTITLFEDREMIKKRLENYKDLFTESQLKKLYRRHYTGWGRLSAKLINGIRDRESQKTILDYLISDGRANRNFMQLINDDGLSFKSIISKAQSGSHSDNLKEVVGELAGSPAIKKGILQSLKIVDELVKVMGYEPEQIVVEMARENQTTNQGRRNSRQRYKLLEDGVKNLASDLNGDILKEYPTDNQALQNERLFLYYLQNGRDMYTGEALDIDNLSQYDIDHIVPQAFIKDDSIDNRVLVSSAKNRGKSDDVPSIDIVKARKAFWKKLLDAKLISQRKYDNLTKAERGGLTPDDKAGFIQRQLVETRQITKHVARILDERFNNKVDDNNKPIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADETVVVKDDIEVNNETGEIAWDKKKHFATVRKVLSYPQVNIVKKTEVQTGGFSKESILAHSNSDKLIPRKTKDIYLDPKKYGGFDSPIVAYSVLVLADIKKGKAQKLKTVKELIGITIMERERFEKNPSAFLESKGYLNIRTDKLIILPKYSLFELENGRRRLLASAGELQKGNELALPTQYMKFLYLASRYNESKGKPEEIEKKQEFVNQHISYFDDILQLINDFSKRVILADANLEKINKLYSDNKDNTPVDELAKNIINLFTFTSLGAPAAFKFFDKSVDRKRYTSTKEVLDSTLIHQSITGLYETRIDLGKLGED

SEQ ID NO: 644 - protein, 1378 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVIDLSTKAPLSASMIQRYDEHHEDLKHLKQFVKASLPENYREVFADSSKDGYAGYIEGKTSQEAFYKYLLKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIIQTLTLFEDREMIKKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRSRQRLTTLRESLGNLKSNILEEKKPKYVKDQVENHHLSDDRLFLYYLQNGKDMYTDDELDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGLYRRKKLSKIVREDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNTSAFLESKGYLNIRDDKLMILPKYSLFELENGRRRLLASAGELQKGNELALPTQFMKFLYLASRYNESKGKPEEIEKKQEFVNQHVSYFDDILQLINDFSNRVILADANLEKINKLYQDNKENIPVDELANNIINLFTFTSLGAPAAFKFFDKIVDRKRYTSTKEVLNSTLIHQSITGLYETRIDLGKLGEG

SEQ ID NO: 645 - protein, 1370 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLIYLALAHIIKFRGHFLIEDDRFDVRNTDIQKQYQAFLEIFDTTFENNDLLSQNVDVEAILTDKISKSAKKDRILARYPNQKSTGIFAEFLKLIVGNQADFKKHFNLEDKTPLQFAKDSYDEDLENLLGQIGDEFADLFSAAKKLYDSVLLSGILTVTDLSTKAPLSASMIQRYDEHREDLKQLKQFVKASLPEKYQEIFADSSKDGYAGYIEGKTNQEAFYKYLSKLLTKQEGSEYLLEKIKNEDFLRKQRTFDNGSIPHQVHLTELRAIIRRQSEYYPFLKENLDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIRKRLDIYKDFFTESQLKKLYRRHYTGWGRLSAKLINGIRNKENQKTILDYLIDDGSANRNFMQLIKDAGLSFKPIIDKARTGSHSDNLKEVVGELAGSPAIKKGILQSLKIVDELVKVMGYEPEQIVVEMARENQTTAKGLSRLRQRLTTLRESLANLKSNILEEKKPKYVKDQVENHHLSDDRLFLYYLQNGKDMYTDDELDIDNLSQYDIDHIIPQAFIKDDSIDNRVLVSSAKNRGKSDDVPSVEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASADELQKGNELALPTQFMKFLYLASRYNELKGKPEEIEQKQEFVVQHVSYFDDILQIINDFSNRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 646 - protein, 1377 aa, Streptococcus agalactiae
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATMQEEKYYHEKFPTIYHLRKELADKKEKADLRLVYLALAHIIKFRGHFLIEDDRFDVRNTDIQKQYQAFLEIFDTTFENNHLLSQNVDVEAILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHHEDLKHLKQFVKASLPENYREVFADSSKDGYAGYIEGKTNQEAFYKYLLKLLTKQEGSEYFLEKIKNEDFLRKQRTFDNGSIPHQVHLTELRAIIRRQSEYYPFLKENQDRIEKILTFRIPYYVGPLAREKSDFAWMTRKTDDSIRPWNFEDLVDKEKSAEAFIHRMTNNDLYLPEEKVLPKHSLIYEKFTVYNELTKVRFLAEGFKDFQFLNRKQKETIFNSLFKEKRKVTEKDIISFLNKVDGYEGIAIKGIEKQFNASLSTYHDLKKILGKDFLDNTDNELILEDIVQTLTLFEDREMIKKCLDIYKDFFTESQLKKLYRRHYTGWGRLSAKLINGIRNKENQKTILDYLIDDGSANRNFMQLINDDDLSFKPIIDKARTGSHSDNLKEVVGELAGSPAIKKGILQSLKIVDELVKVMGYEPEQIVVEMARENQTTAKGLSRSRQRLTTLRESLANLKSNILEEKKPKYVKDQVENHHLSDDRLFLYYLQNGRDMYTKKALDIDNLSQYDIDHIIPQAFIKDDSIDNRVLVSSAKNRGKSDDVPSIEIVKARKMFWKNLLDAKLMSQRKYDNLTKAERGGLTSDDKARFIQRQLVETRQITKHVARILDERFNNEVDNGKKICKVKIVTLKSNLVSNFRKEFGFYKIREVNDYHHAHDAYLNAVVAKAILTKYPQLEPEFVYGMYRQKKLSKIVHEDKEEKYSEATRKMFFYSNLMNMFKRVVRLADGSIVVRPVIETGRYMGKTAWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRDDKLMILPKYSLFELENGRRRLLASAGELQKGNELALPTQFMKFLYLASRYNESKGKPEEIEKKQEFVNQHVSYFDDILQLINDFSKRVILADANLEKINKLYQDNKENIPVDELANNIINLFTFTSLGAPAAFKFFDKIVDRKRYTSTKEVLNSTLIHQSITGLYETRIDLGKLGED

SEQ ID NO: 647 - protein, 1370 aa, Streptococcus agalactiae
  misc_feature (117)..(117): Xaa can be any naturally occurring amino acid
MNKPYSIGLDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYXIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 648 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKADLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 649 - protein, 1370 aa, Streptococcus agalactiae
MNKPYSIGLDIGTNSVGYSVVTDDYKVPAKKMRVLGNTDKEYIKKNLIGALLFDGGNTASDRRLKRTARRRYTRRRNRILYLQEIFAEEMSKVDDSFFHRLEDSFLVEDDKRGSKYPIFATMQEEKDYHEKFPTIYHLRKELADKKEKANLRLVYLALAHIIKFRGHFLIEDDSFDVRNTDIQRQYQAFLEIFDTTFENNHLLSQNIDVEGILTDKISKSAKKDRILAQYPNQKSTGIFAEFLKLIVGNQADFKKHFNLEDKTPLQFAKDSYDEDLENLLGQIGDEFADLFSVAKKLYDSVLLSGILTVTDLSTKAPLSASMIQRYDEHREDLKQLKQFVKASLPEKYQEIFTDSSKDGYAGYIEGKTNQGAFYKYLSKLLTKQEGSEYFLEKIKNEDFLRKQRTFDNGSIPHQVHLTELKAIIRRQSEYYPFLKENLDRIEKILTFRIPYYVGPLAREKSDFAWMTRKTDDSIRPWNFEELVDKEASAEAFIHRMTNNDLYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLKKILDKDFLDNPDNESILEDIVQTLTLFEDREMIKKRLENYKDLFTESQLKKLYRRHYTGWGRLSAKLINGIRDKESQKTILDYLISDGRANRNFMQLIHDDGLSFKPIIDKAQAGSHSDNLKEVVGELAGSPAIKKGILQSLKIVDELVKVMGYEPEQVVVEMARENQTTNQGRRNTRQRYKLLEEGVKNLASDLNGNILKEYPTDNQALQNERLFLYYLQNGRDMYTGEALDIDNLSQYDIDHIVPQAFIKDDSIDNRVLVSSAKNRGKSDNVPSIDIVKARKAFWKKLLDAKLMSQRKYDNLTKAERGGLTSDDKARFIQRQLVETRQITKHVARILDERFNNELDSKGRRIRKVKIVTLKSNLVSNFRKEFGFYKIREVNDYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQVNIVKKTEIQTGGFSKESILAHGNSDKLIPRKTKDIYLDPKKYGGFDSPIVAYSVLVVADIKKGKAQKLKTVTELLGITIMERFRFEKNPSAFLESKGYLNIRDDKLMILPKYSLFELENGRRRLLASAGELQKGNELALPTQYMKFLYLASRYNELKGKPEEIEQKQEFVVQHVSYFDDILQIINDFSNRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 650 - protein, 1370 aa, Streptococcus agalactiae
  misc_feature (9)..(9): Xaa can be any naturally occurring amino acid
MNKPYSIGXDIGTNSVGWSIITDDYKVPAKKMRVLGNTDKEYIKKNLIGALLFDGGNTAADRRLKRTARRRYTRRRNRILYLQEIFAEEMSKVDDSFFHRLEDSFLVEEDKRGSKYPIFATLQEEKDYHEKFSTIYHLRKELADKKEKADLRLIYIALAHIIKFRGHFLIEDDSFDVRNTDISKQYQDFLEIFNTTFENNDLLSQNVDVEAILTDKISKSAKKDRILAQYPNQKSTGIFAEFLKLIVGNQADFKKYFNLEDKTPLQFAKDSYDEDLENLLGQIGDEFADLFSAAKKLYDSVLLSGILTVIDLSTKAPLSASMIQRYDEHREDLKQLKQFVKASLPEKYQEIFADSSKDGYAGYIEGKTNQEAFYKYLSKLLTKQEDSENFLEKIKNEDFLRKQRTFDNGSIPHQVHLTELKAIIRRQSEYYPFLKENQDRIEKILTFRIPYYIGPLAREKSDFAWMTRKTDDSIRPWNFEDLVDKEKSAEAFIHRMTNNDFYLPEEKVLPKHSLIYEKFTVYNELTKVRYKNEQGETYFFDSNIKQEIFDGVFKEHRKVSKKKLLDFLAKEYEEFRIVDVIGLDKENKAFNASLGTYHDLEKILDKDFLDNPDNESILEDIVQTLTLFEDREMIKKRLENYKDLFTESQLKKLYRRHYTGWGRLSAKLINGIRDKESQKTILDYLIDDGRSNRNFMQLINDDGLSFKSIISKAQAGSHSDNLKEVVGELAGSPAIKKGILQSLKIVDELVKVMGYEPEQIVVEMARENQTTNQGRRNSRQRYKLLDDGVKNLASDLNGNILKEYPTDNQALQNERLFLYYLQNGRDMYTGEALDIDNLSQYDIDHIIPQAFIKDDSIDNRVLVSSAKNRGKSDDVPSLEIVKDCKVFWKKLLDAKLMSQRKYDNLTKAERGGLTSDDKARFIQRQLVETRQITKHVARILDERFNNELDSKGRRIRKVKIVTLKSNLVSNFRKEFGFYKIREVNNYHHAHDAYLNAVVAKAILTKYPQLEPEFVYGDYPKYNSYKTRKSATEKLFFYSNIMNFFKTKVTLADGTVVVKDDIEVNNDTGEIVWDKKKHFATVRKVLSYPQNNIVKKTEIQTGGFSKESILAHGNSDKLIPRKTKDIYLDPKKYGGFDSPIVAYSVLVVADIKKGKAQKLKTVTELLGITIMERSRFEKNPSAFLESKGYLNIRADKLIILPKYSLFELENGRRRLLASAGELQKGNELALPTQFMKFLYLASRYNESKGKPEEIEKKQEFVNQHVSYFDDILQLINDFSKRVILADANLEKINKLYQDNKENISVDELANNIINLFTFTSLGAPAAFKFFDKIVDRKRYTSTKEVLNSTLIHQSITGLYETRIDLGKLGED

SEQ ID NO: 651 - protein, 1125 aa, Streptococcus anginosus
MNGLVLGLDIGIASVGVGILNKETGEIIHANSRIFPAATADSNVERRGFRQGRRLGRRKKHRSARLNNLFEEFGFITDFSAIPLNLNPYALRVKGLSEELTNEELFIALKNIIKRRGISYLDDASEDGETASNEYGKAVEENRKLLADKTPGQIQLERFEKYGQVRGDFTVVENGENHRLINVFSTSAYKKEAERILRRQQEFNVRISDEFIEAYLTILTGKRKYYHGPGNEKSRTDYGRFRTDGTTLDNIFGILIGKCTFYPDEYRAAKASYTAQEFNLLNDLNNLTVPTETKKLSPEQKRQIVEYARTAKTLGTPTLLKYIAKLVDGSIDDIKGYRIDKSDKPEMHTFDAYRKMRTLDLVNIDALSRETLDDLAHILTLNTESEGILEALNSKMPSTFTKEQIDELIQFRKKNSAVFGKGWHNFSLKLMNELISELYETSEEQMTILTRLGKQRSREISKRTKYIDEKELTEEIYNPVVAKSVRQAIKIINEATKRYGIFDNIVIEMARENNEEDAKKDYIKRQKANQDEKNASMEKAAFQYNGKKELPDSIFHGHKELATKIRLWHQQGERCLYTGKNISIRDLIHNPHQYEIDHILPLSLSFDDGLANKVLVLATANQEKGQRTPFQAIDSMDDAWSYREFKQYVRNSKSLSNKKKDYLLTEEDISKIEVKQKFIERNLVDTRYSSRVVLNTLQEFYKTNDFDTKISVVRGQFTSQLRRKWKIEKSRDTYHHHAVDALIIAASSQLRLWKKQNNPLISYKEGQFVDPETGEILSLTDDEYKELVFRPPYDYFVDTLKSKSFEDSILFSYQVDSKYNRKISDATIYGTRKAQLGKDKQEETYVLGKIKDIYSQKGYEDFIKRYNKDETQFLIYHKDPQTFEKVIEEILKTYPDKELNEKGKEIPCNPFEKYRQENGPIRKYSKKGKGPEIKSLKYYDNKLGNHIDITPVNSQNQVVLQSLKPWRTDVYFNPRTSKYELMGLKYSDLRFEKGSGSYGISPEKYNKVKAKEGVNEDSEFKFTLYKNDLILIKDTETGEQQLFRYGSRNDTSKHYVELKPYEKAKFEGNQQLMNLLGTVAKGGQCLKGINKPNLSIYKVKTDVLGNKYFIKKEGDQPQLNFKKKF

SEQ ID NO: 652 - protein, 1386 aa, Streptococcus anginosus
MNQKYSIGLDIGTNSVGWAVITDDYKVPAKKMKVLGNTDKQSIKKNLLGALLFDSGETAEATRLKRTARRRYTRRRNRLRYLQEIFAEEMMQVDESFFQRLDDSFLVDEDKRGERHPIFGNIAAEVKYHDEFPTIYHLRKHLADISQKADLRLVYLALAHMIKFRGHFLIEGQLKAENTNVQALFKDFVEVYDKTVEESHLSEITVDALSILTEKVSKSRRLENLIAHYPAEKKNTLFGNLIALFLGLQPNFKTNFQLSEDAKLQFSKDTYEEDLEGLLGEVGDEYADLFASAKNLYDAILLSGILTVDDNSTKAPLSASMVKRYEEHQKDLKKFEDFIKVNALDQYNAIFKDKNKKGYAGYIESGVKQDEFYKYLKGILLQINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENAQIIEDIIQTLTLFEDREMIRQRLQKYSDIFTKAQLKKLERRHYTGWGRLSYKLINGIRNKENKKTILDYLIDDGYANRNFMQLINDDALSFKEEIAKAQIIGDVDDIANVVHDLPGSPAIKKGILQSVKIVDELVKVMGHNPANIIIEMARENQTTDRGRRNSQQRLKLLQDSLKNLDNPVNIKNVENQQLQNDRLFLYYIQNGKDMYTGETLDINNLSQYDIDHIIPQAYIKDDSFDNRVLTSSSENRGKSDNVPSIEVVCARKADWMRLRKAGLISQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGVKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSTLIHQSITGLYETRIDLSKLGED

SEQ ID NO: 653 - protein, 1396 aa, Streptococcus anginosus
MTKPYSIGLDIGTNSVGWAVITDDYKVPAKKMKVLGNTNRDYIKKNLLGALLFDGGETAEGRRLKRTARRRYTRRKNRLRYLQEIFAEEMMQVDESFFQRLDDSFLVEEDKQGSKYPIFGTLKEEKEYHKKFKTIYHLREELANSKEKADLRLVYLALAHMIKFRGHFLYEGDLKAENTDVQALFKDFVEEYDKTIEESHLSEITVDALSILTEKVSKSSRLENLIAHYPTEKKNTLFGNLIALSLGLQANFKTNFQLSEDAKLQFSKDTYEEDLEGLLGEVGDEYADLFVSAKNLYDAILLSGILTVDDNSTKAPLSASMVKRYKEHKEELAAFKRFIKEKLPKKYEEIFKDDTKNGYAGYVGADKKLRKRSGKLATEEEFYKYVKGILNKVEGADYFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYETFTVYNELTKVKYVNEQGEAKFFDTNMKQEIFDHVFKENRKVTKDKLLNYLNKEFEEFRIVNLTGLDKENKAFNASLGTYHDLRKILDKSFLDDKVNEKIIEDIIQTLTLFEDREMIRQRLQKYSDIFTTQQLKELERRHYTGWGRLSYKLINGIRNKENKKTILDYLIDDGYANRNFMQLINDDALSFKEEIARAQIIGDVDDIANVVHDLPGSPAIKKGILQSVKIVDELVKVMGHNPTNIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTENDKAGFIKRQLVETRQITKHVAQVLDARFNAKHDENKKVIRDVKIITLKSNLVSQFRKDFKFYKVREINDYHHAHDAYLNAVIGTALLKKYPKLASEFVYGEFKKYDVRKFIAKSDKEIGKATAKYFFYSNLMNFFKKEVKFADGTVVERPDIETSEDGEIAWNKQTDFKIVRKVLSYPQVNIVKKTEVQTHGLDRGKPRGLFNANPSPKPKPDSSENLVGIKRNLDPKKYGGYAGISNSYAVLVKAIIEKGVKKKETMVLEFQGISILDRITFEKDKRAFLLGKGYKDIKKIIELPKYSLFELKDGSRRMLASILSTNNKRGEIHKGNELFVPQKFTTLLYHAKRINNPINKDHIEYVKKHRDDFKELLNYVLEFNEKYVGATKNGERLKEAVADFDSKSNEEICTSFLGAVNSKNAGLFELTSLGSASDFEFLGVKIPRYRDYTPSSLLKDSILIHQSITGLYETRIDLSKLGED

SEQ ID NO: 654 - protein, 1375 aa, Streptococcus canis
MEKKYSIGLDIGTNSVGWAVITDDYKVPSKKFKVLGNTNRKSIKKNLMGALLFDSGETAEATRLKRTARRRYTRRKNRIRYLQEIFANEMAKLDDSFFQRLEESFLVEEDKKNERHPIFGNLADEVAYHRNYPTIYHLRKKLADSPEKADLRLIYLALAHIIKFRGHFLIEGKLNAENSDVAKLFYQLIQTYNQLFEESPLDEIEVDAKGILSARLSKSKRLEKLIAVFPNEKKNGLFGNIIALALGLTPNFKSNFDLTEDAKLQLSKDTYDDDLDELLGQIGDQYADLFSAAKNLSDAILLSDILRSNSEVTKAPLSASMVKRYDEHHQDLALLKTLVRQQFPEKYAEIFKDDTKNGYAGYVGIGIKHRKRTTKLATQEEFYKFIKPILEKMDGAEELLAKLNRDDLLRKQRTFDNGSIPHQIHLKELHAILRRQEEFYPFLKENREKIEKILTFRIPYYVGPLARGNSRFAWLTRKSEEAITPWNFEEVVDKGASAQSFIERMTNFDEQLPNKKVLPKHSLLYEYFTVYNELTKVKYVTERMRKPEFLSGEQKKAIVDLLFKTNRKVTVKQLKEDYFKKIECFDSVEIIGVEDRFNASLGTYHDLLKIIKDKDFLDNEENEDILEDIVLTLTLFEDREMIEERLKTYAHLFDDKVMKQLKRRHYTGWGRLSRKMINGIRDKQSGKTILDFLKSDGFSNRNFMQLIHDDSLTFKEEIEKAQVSGQGDSLHEQIADLAGSPAIKKGILQTVKIVDELVKVMGHKPENIVIEMARENQTTTKGLQQSRERKKRIEEGIKELESQILKENPVENTQLQNEKLYLYYLQNGRDMYVDQELDINRLSDYDVDHIVPQSFIKDDSIDNKVLTRSVENRGKSDNVPSEEVVKKMKNYWRQLLNAKLITQRKFDNLTKAERGGLSEADKAGFIKRQLVETRQITKHVARILDSRMNTKRDKNDKPIREVKVITLKSKLVSDFRKDFQLYKVRDINNYHHAHDAYLNAVVGTALIKKYPKLESEFVYGDYKVYDVRKMIAKSEQEIGKATAKRFFYSNIMNFFKTEVKLANGEIRKRPLIETNGETGEVVWNKEKDFATVRKVLAMPQVNIVKKTEVQTGGFSKESILSKRESAKLIPRKKGWDTRKYGGFGSPTVAYSILVVAKVEKGKAKKLKSVKVLVGITIMEKGSYEKDPIGFLEAKGYKDIKKELIFKLPKYSLFELENGRRRMLASATELQKANELVLPQHLVRLLYYTQNISATTGSNNLGYIEQHREEFKEIFEKIIDFSEKYILKNKVNSNLKSSFDEQFAVSDSILLSNSFVSLLKYTSFGASGGFTFLDLDVKQGRLRYQTVTEVLDATLIYQSITGLYETRTDLSQLGGD

SEQ ID NO: 655 - protein, 1345 aa, Streptococcus constellatus
MGKPYSIGLDIGTNSVGWAVVTDDYKVPAKKMKVLGNTDKQSIKKNLLGALLFDSGETAEATRLKRTARRRYTRRKNRLRYLQEIFTGEMNKVDENFFQRLDDSFLVDEDKRGEHHPIFGNIAAEVKYHDDFPTIYHLRRHLADTSKKADLRLVYLALAHMIKFRGHFLYEGDLKAENTDVQALFKDFVEEYDKTIEESHLSEITVDALSILTEKVSKSSRLENLIAHYPTEKKNTLFGNLIALSLDLHPNFKTNFQLSEDAKLQFSKDTYEEDLEGFLGEVGDEYADLFASAKNLYDAILLSGILTVDDNSTKAPLSASMVKRYEEHQKDLKKLKDFIKVNAPDQYNAIFKDKNKKGYASYIESGVKQDEFYKYLKGILLKINGSGDFLDKIDREDFLRKQRTFDNGSIPHQIHLQEMHAILRRQGEHYPFLKENQDKIEKILTFRIPYYVGPLARKGSRFAWAEYKADEKITPWNFDDILDKEKSAEKFITRMTLNDLYLPEEKVLPKHSPLYEAFTVYNELTKVKYVNEQGEAKFFDTNMKQEIFDHVFKENRKVTKDKLLNYLNKEFEEFRIVNLTGLDKENKAFNSSLGTYHDLRKILDKSFLDDKANEKTIEDIIQTLTLFEDREMIRQRLQKYSDIFTKAQLKKLERRHYTGWGRLSYKLINGIRNKENKKTILDYLIDDGYANRNFMQLINDDALSFKEEIARAQIIDDVDDIANVVHDLPGSPAIKKGILQSVKIVDELVKVMGHNPANIIIEMARENQTTDKGRRNSQQRLKLLQDSLKNLDNPVNIKNVENQQLQNDRLFLYYIQNGKDMYTGETLDINNLSQYDIDHIIPQAFIKDNSLDNRVLTRSDKNRGKSDDVPSIEVVHEMKSFWSKLLSVKLITQRKFDNLTKAERGGLTEEDKAGFIKRQLVETRQITKHVAQILDERFNTEFDGNKRRIRNVKIITLKSNLVSNFRKEFELYKVREINDYHHAHDAYLNAVVGNALLLKYPQLEPEFVYGEYPKYNSYRSRKSATEKFLFYSNILRFFKKEDIQTNEDGEIAWNKEKHIKILRKVLSYPQVNIVKKTEEQTGGFSKESILPKGESDKLIPRKTKNSYWDPKKYGGFDSPVVAYSILVFADVEKGKSKKLRKVQDMVGITIMEKKRFEKNPVDFLEQRGYRNVRLEKIIKLPKYSLFELENKRRRLLASAKELQKGNELVIPQRFTTLLYHSYRIEKDYEPEHREYVEKHKDEFKELLEYISVFSRKYVLADNNLTKIEMLFSKNKDAEVSSLAKSFISLLTFTAFGAPAAFNFFGENIDRKRYTSVTECLNATLIHQSITGLYETRIDLSKLGED

SEQ ID NO: 656 - protein, 538 aa, Streptococcus dysgalactiae
DYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIRLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 657 - protein, 1155 aa, Streptococcus dysgalactiae
MDKKYSIGLDIGTNSVGWAVITDDYKVPSKKFKVLGNTDRHSIKKNLIGALLFDSGETAEATRLKRSARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNRRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKYQSYKMEK

SEQ ID NO: 658 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKTYAHLFDDKVMKQLKRRHYTGWGRLSRKLINGIRDKQSGKTILDFLKSDGFANRNFIQLIHDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDDVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWNKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 659 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDMDKLFIQLVQTYNQLFEENPINASRVDAKAILSARLSKSRRLENLIAQLPGEKRNGLFGNLIALSLGLTPNFKSNFDLAEDAKLQLSKDTYDDDLDNLLAQIGDQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 660 - protein, 1371 aa, Streptococcus dysgalactiae
MDKKYSIGLDIGTNSVGWAVITDDYKVPSKKFKVLGNTDRHSIKKNLIGALLFDSGETAEATRLKRTARRRYTRRKNRIRYLQEIFSSEMSKVDDSFFHRLEESFLVEEDKKHERHPIFGNIVDEVAYHEKYPTIYHLRKKLADSTDKADLRLIYLALAHMIKFRGHFLIEGDLNPDNSDVDKLFIQLVQTYNQLFEEKPINASGVDAKAILSARLSKSKRLENLIAQLPGEKKNGLFGNLIALSLGLTPNFKSNFDLAEDAKLQLSKDTYDDDLDNLLAQIGNQYADLFLAAKNLSDAILLSDILRVNSEITKAPLSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPEFLSGKQKEAIVDLLFKTNRKVTVKQLKEDYFKKIECFDSVEISGVEDRFNASLGTYHDLLKIIKDKDFLDNEENEDILEDIVLTLTLFEDKEMIEERLKKYANLFDDKVMKQLKRRHYTGWGRLSRKLINGIRDKQSGKTILDFLKSDGFANRNFMQLINDDSLTFKEAIQKAQVSGQGHSLHEQIANLAGSPAIKKGILQSVKVVDELVKVMGHKPENIVIEMARENQTTQKGQKNSRERMKRIEEGIKELGSQILKEHPVENTQLQNEKLYLYYLQNGRDMYVDQELDINRLSDYDVDHIVPQSFIKDDSIDNKVLTRSDKNRGKSDNVPSEEVVKKMKNYWRQLLNAKLITQRKFDNLTKAERGGLSELDKAGFIKRQLVETRQITKHVAQILDSRMNTKYDENDKLIREVKVITLKSKLVSDFRKDFQFYKVREINNYHHAHDAYLNAVVGTALIKKYPKLESEFVYGDYKVYDVRKMIAKSEQEIGKATAKRFFYSNIMNFFKTEITLANGEIRKRPLIETNEETGEIVWDKGRDFATVRKVLSMPQVNIVKKTEVQTGALTNESIYARGSFDKLISRKHRFESSKYGGFGSPTVTYSVLVVAKSKVQDGKVKKIKTGKELIGITLLDKLVFEKNPLKFIEDKGYGNVQIDKCIKLPKYSLFEFENGTRRMLASVMANNNSRGDLQKANEMFLPAKLVTLLYHAHKIESSKELEHEAYILDHYNDLYQLLSYIERFASLYVDVEKNISKVKELFSNIESYSISEICSSVINLLTLTASGAPADFKFLGTTIPRKRYGSPQSILSSTLIHQSITGLYETRIDLSQLGGD

SEQ ID NO: 661 - protein, 1370 aa, Streptococcus gallolyticus; identical to SEQ ID NO: 209

SEQ ID NO: 662 - protein, 1375 aa, Streptococcus infantarius
MEKSYSIGLDIGTNSVGWAVITDDYKVPAKKMKVLGNTDKKYIKKNLLGALLFDSGETAEVTRLKRTARRRYTRRKNRLRYLQEIFAKEMTKVDESFFQRLEESFLTDDDKTFDSHPIFGNKAEEDAYHQKFPTIYHLRKYLADSQEKADLRLVYLALAHMIKYRGHFLIEGELNAENTDVQKLFNVFVETYDKIVDESHLSEIEVDASSILTEKVSKSRRLENLIKQYPTEKKNTLFGNLIALALGLQPNFKTNFKLSEDAKLQFSKDTYEEDLEELLGKVGDDYADLFISAKNLYDAILLSGILTVDDNSTKAPLSASMIKRYVEHHEDLEKLKEFIKINKLKLYHDIFKDKTKNGYAGYIDNGVKQDEFYKYLKTILTKIDDSDYFLDKIERDDFLRKQRTFDNGSIPHQIHLQEMHSILRRQGDYYPFLKENQAKIEKILTFRIPYYVGPLARKDSRFAWANYHSDEPITPWNFDEVVDKEKSAEKFITRMTLNDLYLPEEKVLPKHSHVYETFTVYNELTKIKYVNEQGESFFFDANMKQEIFDHVFKENRKVTKAKLLSYLNNEFEEFRINDLIGLDKDSKSFNASLGTYHDLKKILDKSFLDDKTNGQIIEDIVLTLTLFEDRDMIHERLQKYSDFFTSQQLKKLERRHYTGWGRLSYKLINGIRNKENNKTILDFLIDDGHANRNFMQLINDESLSFKTIIQEAQVVGDVDDIEAVVHDLPGSPAIKKGILQSVKIVDELVKVMGDNPDNIVIEMARENQTTGYGRNKSNQRLKRLQDSLKEFGSDILSKKKPSYVDSKVENSHLQNDRLFLYYIQNGKDMYTGEELDIDRLSDYDIDHIIPQAFIKDNSIDNKVLTSSAKNRGKSDDVPSIEIVRNRRSYWYKLYKSGLISKRKFDNLTKAERGGLTEADKAGFIKRQLVETRQITKHVAQILDARFNTKRDENDKVIRDVKVITLKSNLVSQFRKEFKFYKVREINDYHHAHDAYLNAVVGTALLKKYPKLTPEFVYGEYKKYDVRKLIAKSSDDYSEMGKATAKYFFYSNLMNFFKTEVKYADGRVFERPDIETNADGEVVWNKQKDFDIVRKVLSYPQVNIVKKVEAQTGGFSKESILSKGDSDKLIPRKTKKVYWNTKKYGGFDSPTVAYSVLVVADIEKGKAKKLKTVKELVGISIMERSFFEENPVSFLEKKGYHNVQEDKLIKLPKYSLFEFEGGRRRLLASATELQKGNEVMLPAHLVELLYHAHRIDSFNSTEHLKYVSEHKKEFEKVLSCVENFSNLYVDVEKNLSKVRAAAESMTNFSLEEISASFINLLTLTALGAPADFNFLGEKIPRKRYTSTKECLSATLIHQSVTGLYETRIDLSKLGEE

SEQ ID NO: 663 - protein, 1368 aa, Streptococcus iniae
MRKPYSIGLDIGTNSVGWAVITDDYKVPSKKMRIQGTTDRTSIKKNLIGALLFDNGETAEATRLKRTTRRRYTRRKYRIKELQKIFSSEMNELDIAFFPRLSESFLVSDDKEFENHPIFGNLKDEITYHNDYPTIYHLRQTLADSDQKADLRLIYLALAHIIKFRGHFLIEGNLDSENTDVHVLFLNLVNIYNNLFEEDIVETASIDAEKILTSKTSKSRRLENLIAEIPNQKRNMLFGNLVSLALGLTPNFKTNFELLEDAKLQISKDSYEEDLDNLLAQIGDQYADLFIAAKKLSDAILLSDIITVKGASTKAPLSASMVQRYEEHQQDLALLKNLVKKQIPEKYKEIFDNKEKNGYAGYIDGKTSQEEFYKYIKPILLKLDGTEKLISKLEREDFLRKQRTFDNGSIPHQIHLNELKAIIRRQEKFYPFLKENQKKIEKLFTFKIPYYVGPLANGQSSFAWLKRQSNESITPWNFEEVVDQEASARAFIERMTNFDTYLPEEKVLPKHSPLYEMFMVYNELTKVKYQTEGMKRPVFLSSEDKEEIVNLLFKKERKVTVKQLKEEYFSKMKCFHTVTILGVEDRFNASLGTYHDLLKIFKDKAFLDDEANQDILEEIVWTLTLFEDQAMIERRLVKYADVFEKSVLKKLKKRHYTGWGRLSQKLINGIKDKQTGKTILGFLKDDGVANRNFMQLINDSSLDFAKIIKNEQEKTIKNESLEETIANLAGSPAIKKGILQSIKIVDEIVKIMGQNPDNIVIEMARENQSTMQGIKNSRQRLRKLEEVHKNTGSKILKEYNVSNTQLQSDRLYLYLLQDGKDMYTGKELDYDNLSQYDIDHIIPQSFIKDNSIDNTVLTTQASNRGKSDNVPNIETVNKMKSFWYKQLKSGAISQRKFDHLTKAERGALSDFDKAGFIKRQLVETRQITKHVAQILDSRFNSNLTEDSKSNRNVKIITLKSKMVSDFRKDFGFYKLREVNDYHHAQDAYLNAVVGTALLKKYPKLEAEFVYGDYKHYDLAKLMIQPDSSLGKATTRMFFYSNLMNFFKKEIKLADDTIFTRPQIEVNTETGEIVWDKVKDMQTIRKVMSYPQVNIVMKTEVQTGGFSKESIWPKGDSDKLIARKKSWDPKKYGGFDSPIIAYSVLVVAKIAKGKTQKLKTIKELVGIKIMEQDEFEKDPIAFLEKKGYQDIQTSSIIKLPKYSLFELENGRKRLLASAKELQKGNELALPNKYVKFLYLASHYTKFTGKEEDREKKRSYVESHLYYFDEIMQIIVEYSNRYILADSNLIKIQNLYKEKDNFSIEEQAINMLNLFTFTDLGAPSAFKFFNGDIDRKRYSSTNEIINSTLIYQSPTGLYETRIDLSKLGGK

SEQ ID NO: 664 - protein, 1392 aa, Streptococcus mitis
MNNNNYSIGLDIGTNSVGWAVITDDYKVPSKKMKVLGNTDKHFIKKNLIGALLFDEGATAEDRRFKRTARRRYTRRKNRLRYLQEIFSEEMSKVDSSFFHRLDDSFLVPEDKRGSKYPIFATLAEEKEYHKKFPTIYHLRKHLADSKEKTDLRLIYLALAHMIKYRGHFLYEESFDIKNNDIQKIFSEFISIYDNTFEGSSLSGQNAQVEAIFTDKISKSAKRERILKLFAYEKSTDLFSEFLKLIVGNQADFKKHFDLEEKAPLQFSKDTYDEDLENLLGQIGDDFADLFLVAKKLYDAILLSGILTVTDSSTKAPLSASMIERYENHQKDLAALKQFIQNNLQEKYDEVFSDQSKDGYARYINGKTTQEAFYKYIKNLLSKFEGSDYFLDKIEREDFLRKQRTFDNGSIPHQIHLQEMNAIIRRQGEHYPFLKEYKEKIETILTFRIPYYVGPLARGNRNFAWLTRNSDQAIRPWNFEEIVDQASSAEEFINKMTNYDLYLPEEKVLPKHSLLYETFAVYNELTKVKFISEGLRDYQFLDSGQKKQIVNQLFKEKRKVTEKDIIQYLHNVDGYDGIELKGIEKQFNASLSTYHDLLKIIKDKEFMDDPKNEEILENIVHTLTIFEDREMIKQRLAQYASIFDKKVIKALTRRHYTGWGKLSAKLINGICDKKTGKTILDYLIDDGYSNRNFMQLINDDGLSFKDIIQKAQVVGKTNDVKQVVQELPGSPAIKKGILQSIKLVDELVKVMGHAPESIVIEIARENQTTARGKKNSQQRYKRIEDALKNLAPGLDSNILKEHPTDNIQLQNDRLFLYYLQNGKDMYTGEALDINQLSSYDIDHIVPQAFIKDDSLDNRVLTSSKDNRGKSDNVPSLEVVQKRKAFWQQLLDSKLISEHKFNNLTKAERGGLDERDKVGFIRRQLVETRQITKHVAQILDARFNTEVNEKDKKNRTVKIITLKSNLVSNFRKEFKLYKVREINDYHHAHDAYLNAVVAKAILKKYPKLEPGFVYGDYQKYDIKRYISRSKDPKEVEKATEKYFFYSNLLNFFKEEVHYADGTIVKRENIEYSKDTGEIAWNKEKDFATIKKVLSLPQVNIVKKTEIQTHGLDRGKPRGLFNSNPSPKPSEDRKENLVPIKQGLDPRKYGGYAGISNSYAVLVKAIIEKGAKKQQKTVLEFQGISILDKINFEKNKENYLLEKGYIKILSTITLPKYSLFEFPDGTRRRLASILSTNNKRGEIHKGNELVIPEKYTTLLYHAKNINKTLEPEHLEYVEKHRNDFAKLLEYVLNFNDKYVGALKNGERIRQAFIDWETVDIEKLCFSFIGPRNSKNAGLFELTSQGSASDFEFLGVKIPRYRDYTPSSLLNATLIHQSITGLYETRIDLSKLGED

SEQ ID NO: 665 - protein, 1134 aa, Streptococcus mutans
MANGKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNMRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIVKLVGCSADDIKGYRIDKSDKPEIHTFEAYRKMRTMELIKVDDLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKKAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKSYVKGLKTLSNKKKDYLLTEENIDKIEVKQKFIERNLVDTRYSSRVVLNALQDFYKERKFDTKISVVRGQFTSQLRRKWRIEKTRETYHHHAVDALIIAASSQLNLWKKQNNPLISYKEDQFVDPETGEILSLSDDEYKKLVFKAPYEHFVDTLKSKKFEDSILFSYQVDSKYNRKISGATICGTRKAQLGKDTQEETYVLGKIKDIYSQKGYEDFIKKYKKDKTQFLMYHKDPQTFEKVIEEILKTYPDKELNEKGKEVSCNPFEKYRQENGPVRKYSKKGNGPEIKSLKYYDEVLGKNIDITPKNSLNKVVLRSLNPWRTDVYFNHETRKYEFLGLKYSDLRYLKGEHRYGILIGDYKKIKDKEGIEKESEFKFTLYKNDLILIKDTAKGKEELFRFWSRTGKDNAKTFEKNKIELKPYSKSQFEKGEDTNVLGKLYASSNQLQKSFGTLENLSIYKVRTDVLGNKYFIKKEGDKPQLNFKKKL

SEQ ID NO: 666 - protein, 1134 aa, Streptococcus mutans; identical to SEQ ID NO: 665

SEQ ID NO: 667 - protein, 1128 aa, Streptococcus mutans
MANSKILGLDIGIASVGVGIIDKETGKIIHVNSRIFPAATADSNVERRGFRQGRRLVRRKKHRKVRLADLFLDSNLLTDFSKVSLNLNPYQLRVKGLNEELSNEELFIALKSIVSRRGISYLDDASEDSGANSSEYGKAVEENRKLLEDRTPGQIQLERFEKYGKVRGDFTVVENGENHRLINVFSTSAYKKEAERILRRQQEFNIRIADEFIEAYLTILTGKRKYYHGPGNEKSRTDYGRFRTDGTTLDNIFGILIGKCTFYPDEYRAAKASYTAQEFNLLNDLNNLTVPTETKKLSEEQKRQIIEHAKTVKTLGAPTLLKYIAKLVGCSADDIKGYRIDKSDKPEIHTFEAYRKMRTMELIKVADLSRESLDALAHILTLNTEREGIEEAIRDRFTNKEFNQEQINELVLFRKNNSSLFGKGWHNFSLKLMKELIPELYETSEEQMTILTRLGKQRVKKSSNRTNYIDEKELTEEIYNPVVAKSVRQAIKIINLATKKYGVFDNIVIEMARESNEDDEKKAIQNAQKANEDEKEAALLKAAHQFNGKEELPDSIFHGHKELLTKIRLWHQQGEKCLYTGKTIFINDLIHNPYKYEIDHILPLSLSFDDSLANKVLVLSTANQEKGQRTPFQSLDSMDGAWTYREFKAYVKGLKTLSNKKKDYLLNEEDINKNEVKQKFIERNLVDTRYSSRVVLNTLQDFYKKREFDTKISVVRGQFTSQIRRKWRIEKTRETYHHHAVDALIIAASSQLNLWKKQNNPLISYKEDQFVDPETGEILSLSDDEYKELVFKAPYDHFVDTLKSKKFEDSILFSYQVDSKYNRKISDATIYGTRKARLGKDSQEETYVLGKIKDIYSQKGYEDFIKKYKKDKTQFLMYHKDPQTFEKVIEEILKTYSDKELNEKGKEVPCNPFEKYRQENGPVRKYSKKGNGPEIKSIKYYDNKLGNHIDITPNNSHHQVVLQSLKPWRTDVYFNPKSGKYELMGLKYSDLRFEKVSGDYGISVKKYNEIKSKEGVDENSEFKFTLYKNDLILIKDTESGEQELFRFLSRTMPNQKHYVELKPYDKSKFEGHQKLMDIFGEVAKGGQCLKGLNKSNISIYKVKTDVLGNKYFIKKEGDQPQLNFKKKI

SEQ ID NO: 668 - protein, 1128 aa, Streptococcus mutans; identical to SEQ ID NO: 667

SEQ ID NO: 669 - protein, 1338 aa, Streptococcus mutans
MDLIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 670 - protein, 1338 aa, Streptococcus mutans; identical to SEQ ID NO: 669

SEQ ID NO: 671 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDFFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQSEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGETAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 672 - protein, 1345 aa, Streptococcus mutans; identical to SEQ ID NO: 671

SEQ ID NO: 673 - protein, 1229 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNIQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHY

SEQ ID NO: 674 - protein, 1229 aa, Streptococcus mutans; identical to SEQ ID NO: 673

SEQ ID NO: 675 - protein, 1345 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELIKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 676 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYSFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRIRKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 677 - protein, 1350 aa, Streptococcus mutans
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTLDDKAGFIKRQLVETRQITKHVARMLDERFNKEFDDNNKRICKVKIVTLKSNLVSSFRKEFELYKVREINDYHHAHDAYLNAVVVKALLVKYSKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 678 - protein, 1345 aa, Streptococcus mutans; identical to SEQ ID NO: 675

SEQ ID NO: 679 - protein, 1350 aa, Streptococcus mutans; identical to SEQ ID NO: 676

SEQ ID NO: 680 - protein, 1350 aa, Streptococcus mutans; identical to SEQ ID NO: 677

SEQ ID NO: 681 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLTQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 682 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 683 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 684 - protein, 1345 aa, Streptococcus mutans
MKKPYSIGLDIGTNSVGWAVVTDDYKVPAKKMKVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELSSSFINLLTFTAIGAPAAFKFFDKNIDRKRYTSTTEILNATLIHQSITGLYETRIDLSKLGGD

SEQ ID NO: 685 - protein, 1345 aa, Streptococcus mutans; identical to SEQ ID NO: 681

SEQ ID NO: 686 - protein, 1345 aa, Streptococcus mutans; identical to SEQ ID NO: 682

SEQ ID NO: 687 - protein, 1345 aa, Streptococcus mutans; identical to SEQ ID NO: 683

SEQ ID NO: 688 - protein, 1345 aa, Streptococcus mutans; identical to SEQ ID NO: 684

SEQ ID NO: 689 - protein, 1345 aa, Streptococcus mutans; identical to SEQ ID NO: 682

SEQ ID NO: 690 - protein, 1345 aa, Streptococcus mutans; identical to SEQ ID NO: 682

SEQ ID NO: 691 - protein, 1345 aa, Streptococcus mutans; identical to SEQ ID NO: 682

SEQ ID NO: 692 - protein, 1345 aa, Streptococcus mutans; identical to SEQ ID NO: 682

SEQ ID NO: 693 - protein, 1359 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMMQVDESFFQRLDDSFLVEEDKRGSRYPIFGTLKEEKKYHKEFKTIYHLREKLANSTEKADLRLVYLSLAHMIKFRGHFLIEGQLKAENTNVQALFKDFVEVYDKTVEESHLSEMTVDALSILTEKVSKSRRLENLVECYPTEKKNTLFGNLIALSLGLQPNFKTNFQLSEDAKLQFSKDTYEEDLEGLLGEIGDEYADLFASAKNLYDAILLSGILAVDDNTTKAPLSASMVKRYKEHKEELAAFKRFIKEKLPKKYEEIFKDDTKNGYAGYVGADKKLRKRSGKLATEEEFYKYVKGILNKVEGADVWLDKIDREDFLRKQRTFDNGSIPHQIHLQEMHAILRRQGEHYPFLKENQDKIEKILTFRIPYYVGPLVRKGSRFAWAEYKADEKITPWNFDDILDKEKSAEKFITRMTLNDLYLPEEKVLPKHSLLYETFTVYNELTKVKYVNEQGEAKFFDANMKQEIFDHVFKENRKVTKDKLLNYLNKEFEEFRIVNLTGLDKENKVFNSSLGTYHDLRKILNKSFLDNKENEQIIEDIIQTLTLFEDREMIRQRLQKYSDIFTKAQLKKLERRHYTGWGRLSYKLINGIRDKQSNKTILGYLIDDGYSNRNFMQLINDDALSFKEEIAKAQVIGEMDGLNQVVSDIAGSPAIKKGILQSLKIVDELVKVMGHNPANIVIEMARENQTTAKGRRSSQKRYKRLEEAIKNLDHDLNHKILKEHPTDNQALQNDRLFLYYLQNGRDMYTEDPLDINRLSDYDIDHIIPQAFIKDNSIDNRVLTRSDKNRGKSDDVPSEEVVHKMKPFWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKGDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLETLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLNKLGGD

SEQ ID NO: 694 - protein, 1359 aa, Streptococcus mutans; identical to SEQ ID NO: 693

SEQ ID NO: 695 - protein, 1355 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFAEEMSKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKITGSDYFLDQIEREDFLRKQRTFDNGSIPHQIHLQEMHAILRRQGDYYPFLKENQDRIEKILTFRIPYYVGPLARKNSRFAWAEYHSDEAVTPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTLDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDFASIEELADGFIKLLGFTQLGATSPFSFLGIKLNQKQYTGKKDYLLPCMEATLIHQSITGLYETRIDLSKLGGD

SEQ ID NO: 696 - protein, 1355 aa, Streptococcus mutans; identical to SEQ ID NO: 695

SEQ ID NO: 697 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMDKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 698 - protein, 1345 aa, Streptococcus mutans; identical to SEQ ID NO: 697

SEQ ID NO: 699 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 700 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSYPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFRNLVALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 701 - protein, 1345 aa, Streptococcus mutans; identical to SEQ ID NO: 700

SEQ ID NO: 702 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFGGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 703 - protein, 1345 aa, Streptococcus mutans; identical to SEQ ID NO: 702

SEQ ID NO: 704 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 705 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSYKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 706 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSLAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKGERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFFKESILPKGDSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 707 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 708 - protein, 1345 aa, Streptococcus mutans; identical to SEQ ID NO: 707

SEQ ID NO: 709 - protein, 1345 aa, Streptococcus mutans; identical to SEQ ID NO: 704

SEQ ID NO: 710 - protein, 1345 aa, Streptococcus mutans; identical to SEQ ID NO: 705

SEQ ID NO: 711 - protein, 1345 aa, Streptococcus mutans; identical to SEQ ID NO: 706

SEQ ID NO: 712 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQKLFQEFLAVYDNTFENSSLQEQNVQVEEILTDKISKSAKKDRVLKLFPNEKSNGRFAEFLKLIVGNQADFKKHFELEEKAPLQLSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTLLDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 713 - protein, 1345 aa, Streptococcus mutans; identical to SEQ ID NO: 712

SEQ ID NO: 714 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 715 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEDLEELLGKIGDDYADLFTLAKNLYDAILLSGILTADDSSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKPYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHEENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 716 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 717 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDRNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 718 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRQNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 719 - protein, 1345 aa, Streptococcus mutans; identical to SEQ ID NO: 718

SEQ ID NO: 720 - protein, 1345 aa, Streptococcus mutans; identical to SEQ ID NO: 714

SEQ ID NO: 721 - protein, 1345 aa, Streptococcus mutans; identical to SEQ ID NO: 715

SEQ ID NO: 722 - protein, 1345 aa, Streptococcus mutans; identical to SEQ ID NO: 716

SEQ ID NO: 723 - protein, 1345 aa, Streptococcus mutans; identical to SEQ ID NO: 717

SEQ ID NO: 724 - protein, 1345 aa, Streptococcus mutans; identical to SEQ ID NO: 716

SEQ ID NO: 725 - protein, 1345 aa, Streptococcus mutans; identical to SEQ ID NO: 716

SEQ ID NO: 726 - protein, 1345 aa, Streptococcus mutans; identical to SEQ ID NO: 716

SEQ ID NO: 727 - protein, 1345 aa, Streptococcus mutans; identical to SEQ ID NO: 717

SEQ ID NO: 728 - protein, 1345 aa, Streptococcus mutans
MKKPYSIGLDIGTNSVGWAVVTDDYKVPAKKMKVLGNTDKSHIKKNLLGALLFDSGNTAEDRRLKRTARRRYTRRRNRILYLQEIFSEEMGKVNDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTKQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEYISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPIAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPAAFKFFDKNIDRKRYTSTTEILNATLIHQSITGLYETRIDLSKLGGD

SEQ ID NO: 729 - protein, 1345 aa, Streptococcus mutans; identical to SEQ ID NO: 728

SEQ ID NO: 730 - protein, 1345 aa, Streptococcus mutans
MKKPYSIGLDIGTNSVGWAVVTDDYKVPAKKMKVLGNTDKSHIKKNLLGALLFDSGNTAEDRRLKRTTRRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGCFAEFLKLIVGNQADFKKHFELEEKAPLQFSKDTYEEELEVLLAQIGDNYAELFLSAKKLYDSILLSGILTVTDVSTKAPLSASMIQRYNEHQMDLTQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLASGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 731 - protein, 1345 aa, Streptococcus mutans; identical to SEQ ID NO: 730

SEQ ID NO: 732 - protein, 1350 aa, Streptococcus mutans
MKKPYSIGLDIGTNSVGWAVVTDDYKVPAKKMTVLGNTDKSHIKKNLLGALLFDSGNTAADRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKTPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLSKLGGD

SEQ ID NO: 733 - protein, 1350 aa, Streptococcus mutans; identical to SEQ ID NO: 732

SEQ ID NO: 734 - protein, 1345 aa, Streptococcus mutans
MKKPYSIGLDIGTNSVGWAVVTDDYKVPDKKMKVLGNTDKSHIKKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKTDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDIYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSVEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLKNYSDLLTKEQLKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFYTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 735 - protein, 1345 aa, Streptococcus mutans
MKKPYSIGLDIGTNSVGWAVVTDDYKVSAKKMKVLGNTDKSHIKKNLLGALLFDSGNTAEDRRLKRTARRRYTRRRNRILYLQEIFAEEMSKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVSTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKILTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKAFNASYGTYHDLRKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVEHSQLQNDRLFLYYLQNGRDMYTGEELDIDYLSQYDIDHIIPQAFIKDNSIDNRVLTSSKENRGKSDDVPSKNVVRKMKSYWSKLLSAKLITQRKFDNLTKAERGGLTDDDKAGFIKRQLVETRQITKHVARILDERFHTETDENNKKIRQVKIVTLKSNLVSNFRKEFELYKVREINDYHHTHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 736 - protein, 1345 aa, Streptococcus mutans; identical to SEQ ID NO: 735

SEQ ID NO: 737 - protein, 1345 aa, Streptococcus mutans
MKKPYSIGLDIGTNSVGWSVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRIDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLSKLGGD

SEQ ID NO: 738 - protein, 1345 aa, Streptococcus mutans; identical to SEQ ID NO: 737

SEQ ID NO: 739 - protein, 1355 aa, Streptococcus mutans
MKKSYSIGLDIGTNSVGWAVVTDDYKVPAKKMKVLGNTDKSHIKKNLLGALLFDSGNTAEDRRLKRTARRRYTRRRNRILYLQEIFSEEMGKVDDSFFHRLDESFLTDDDKNFDSHPIFGNKAEEDAYHQKFPTIYHLRKHLADSTEKADLRLVYLALAHMIKFRGHFLIEGELNAENTDVQKLFADFVGVYDRTFDDSHLSEITVDASSILTEKISKSRRLEKLINNYPKEKKNTLFGNLIALSLGLQPNFKTNFKLSEDAKLQFSKDTYEEDLEELLGKIGDDYADLFTLAKNLYDAILLSGILTADDSSTKAPLSASMIKRYAEHHEDLEKLKEFIKANKPELYHDIFKDETKNGYAGYIENGVKQDEFYKYLKNTLSKIAGSDYFLDKIEREDFLRKQRTFDNGSIPHQIHLQEMHAILRRQGDYYPFLKENQDRIEKILTFRIPYYVGPLARKNSRFAWAEYHSDEAVMPWNFDQVIDKESSAQAFIEHMTNNDLYLPNEKVLPKHSPLYEKYTVYNELTKIKYVTEIGEAKFFDANLKQEIFDGLFKHERKVTKKKLRTFLDKNFDEFRIVDIQGLDKETETFNASYATYQDLLKVIKDKVFMDNPENAEILENIVLTLTLFEDREMIKQRLAKYADVFDKKVIDQLARRHYTGWGRLSAKLLNGIRDKQSCKTIMDYLIDDAQSNRNLMQLITDDNLTFKDDIVKAQYVDNSDDLHQVVQSLAGSPAIKKGILQSLKIVDELVKVMGKEPEQIVVEMARENQTTAKGRRNSQQRYKRLKEAIKSLDRDLNHKILKEHPTDNQALQNNRLFLYYLQNGRDMYTGESLDINRLSDYDIDHVIPQAFIKDNSIDNRVLTSSKANRGKSDDVPSEDVVNRMRPFWNKLLSSGLISQRKYNNLTKKELTPDDKAGFIKRQLVETRQITKHVARMLDERFNKEFDDNNKRIRRVKIVTLKSNLVSSFRKEFELYKVREINDYHHAHDAYLNAVVVKALLVKYPKLEPEFVYGEYPKYNSYRERKTATQKMFFYSNIMNMFKSKVKLADDQIVERPMIEVNDETGEIAWDKTKHITTVKKVLSYPQVNIVKKVEEQTIGQNGGLFDDNPKSPLEVIPSKLVPLKKALNPEKYGGYQKPTTAYPILLIVDTKQLIPISVMDKKRFEQNPVKFLKDKGYQQIEKNNFVKLPKYTLVDIGNGIKRLWASSKEVHKGNQLVVSKKSQDLLYHAHHLDNDYSNEYVKNHYQQFDILFNEITSFSKKCKLGKEHIQKIEEAYSKERDSASIEELADGFIKLLGFTQLGATSPFSFLGIKLNQKQYTGKKDYLLPCMEATLIHQSITGLYETRIDLNKLGGD

SEQ ID NO: 740 - protein, 1355 aa, Streptococcus mutans; identical to SEQ ID NO: 739

SEQ ID NO: 741 - protein, 1125 aa, Streptococcus mutans
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLEAAKLLKEIAKLVGCQVEEIKGYRLDNKDKPDLHTFEPFRKLKSNLTTIAVENLSITTLDTLAHILTLNTEREGIEEAIQKELPNIFSDEQITGIIAVRKKNSQIFGKGWHSFSIKLMKELIPELYETSEEQMTILIRLKKVKTNSKITNRTKYINEQEVTDEIYNPVVSKSIRQTVKIINAAIKKYGAFDQIVIEMPRESNEEDERKFIADLQKSNAKEKDDAMKQAALLYNGKAELPHGVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 742 - protein, 1125 aa, Streptococcus mutans
MTNGKILGLDIGIASVGVGIINAKTGNVEHASSRIFPAANADNNVERRSARGGRRLIRRKKHRLKRVEDLFEKYNIDTDFSNLNLNPYQLRVKGLNEQLSNEELFAILKNIAKRRGISYLDDAEDDSVGSSDYAKAIDENRKLLKKQTPGEIQLKRLEKYGQLRGNFTIQDENGEYHRLINVFSTSDYVKEARRILETQSYYNKFITESFVEDYIKILQGKRKYYVGPGNEKSRTDYGIYRTDGETLDNLFGILIGKCGFYPEEYRAAKASYTAQEYNFLNDLNNLTVPTETKKLSTEQKYQLVDFAKTASTLGAAKLLKEIAKLVGCQVEEIKGYRLDNKDKPDLHTFEPFRKLKSNLTTIAVENLSITTLDTLAHILTLNTEREGIEEAIQKELPNIFSDEQITEIIAVRKKNSQIFGKGWHSFSIKLMKELIPELYETSEEQMTILTRLKKVKTNSKITNRTKYINEEEITDEIYNPVVSKSIRQTVKIINATIKKYGAFDQIIIEMPRESNEEDERKFIADLQKSNAKEKDDAMKQAALLYNGKDELPHDVFHGHKELATKIRLWYQQGERCLYSGKHIDIHDLIHNQHMFEIDHVLPLSLSFDDSLANKVLVYSWANQEKGQRTPFQALPQMASAWSFRELRDYISKQKGISKKKRDYLLTEQDINKVEVKQKFIERNLVDTRYVSRVVLNTLQDALKVMNKETKISVIRGQFTSQLRRQWRIDKSRETYHHHAVDALIIAASSQLRLWKKQNNPMFAEDKHGQKINLDTGEVLSDDAYKELVYQAPYQGFVNTISSKSFEDEILFSYQVDSKVNRKISDATIYATRQAQLGKDKKEETYVLGKIKDIYSQAGYDAFRKKYDKDKAVFLMYQKDPETWEKVIEVILRDYKELDDKGKEIGNPFERYKVKHGFVRKYSRKNKGTEIKSLKYYDNKLGNHIDITPNNSKHSVVLQSINPWRADLYFNPETTKYELMGLKYADLSFEKGTGKYSISREKYDEIKEREGISSKSEFKFTLYKNDLILVKDIGNHKELIARFNSKNDTSKHYVELKPWNKAKFDSEEELIPAFGKVAKSGQFIKGLNKPDLSIYKVKTDILGHKYYIKKEGDKPKLNFENKIKNK

SEQ ID NO: 743 - protein, 1125 aa, Streptococcus mutans; identical to SEQ ID NO: 742

SEQ ID NO: 744 - protein, 1125 aa, Streptococcus mutans; identical to SEQ ID NO: 741

SEQ ID NO: 745 - protein, 670 aa, Streptococcus oralis
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIGKIDKNFYRRLDESFRVLGDKSEDIQIKQPFFGNKELETAYHKKYPTIYHLRKHLADADKNSPVADIREVYMALSHIFKYRGHFLTLGKIDPNNINMQNSWIDFIESCQDAFDLEISDESKTIAAIFKSSDNRQEKVKGILSYFQPELAKKDKSIFKQLLQLLFGLKTKFKECFELEEEPDLNFSKENYDENLENLLGTLEEDFPDVFAKLKILRDTILLSDMLTYTGATHARFSATMVERYEEHRKDLQRFKSFVKQNLSEQDYLDIFGRKTPNGFDVDKETKGYVGYISNKMVLTNKQKTIQQNFYDYISGKITGIEGAEYFLNKISDGTFLRKLRTTDNGTIPNQIHAYELEKIIERQGRDYPFLLENKDKLLSILTFKIPYYVGPLAKGNNSRFAWIKRTTSQDVLDNNDEDTKNGKIRPWNYHKLINMDETRDAFITNLIGNDIILLNEKVLPKRSLIYEEVMLQNELTRIKYKDKYGKIHFFDSELRQEIINNLFKTNSKRVSSAMLLAYLENFTNLQAVEIVSGIEKGKSLNSTLKTYNDLKTIFSEDLLDSEIYQKELEEIIKVITVFV

SEQ ID NO: 746 - protein, 1373 aa, Streptococcus oralis
MENKNYSIGLDIGTNSVGWAVITDDYKVPSKKMKVLGNTDKRFIKKNLIGALLFDEGTTAEARRLKRTARRRYTRRKNRLRYLQEIFAEEMSKVDSSFFHRLDDSFLIPEDKKGSKYPIFATLIEEKEYHKQFPTIYHLRKQLADSKEKTDLRLIYLALAHMIKYRGHFLYEDTFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFVAAKKLYDAILLSGILTVTDPSTKAPLSASMIERYENHQKDLATLKQFIKTNLPEKYDEVFSDQSKDGYAGYIDGKTTQESFYKYIKNLLSKFEGADYFLEKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFLDSRQKKDIFYTLFKAEDKRKVTEKDIIQYLHTVDGYDGIELKGIEKQFNASLSTYHDLLKIIKDKEFMDDPNNEEILENIVHTLTIFEDREMIKQRLAQYDSLFDEKVIKALTRRHYTGWGKLSSKLINGIRDKQTGKTILDYLMDDGYNNRNFMQLINDDELSFKEIIKKAQVVGKTDDVKQVVQELPGSPAIKKGILQSIKLVDELVKVMGHEPESIVIEMARENQTTARGKKNSQQRYKRIEDSLKILASGLNAKILKEHPTDNIQLQNDRLFLYYLQNGRDMYTGKPLDINQLSSYDIDHIVPQAFIKDDSLDNRVLTSLKDNRGKSDNVPSLEVVEKMKTFWQQLLDSKLISYRKFNNLTKAERGGLDERDKVGFIKRQLVETRQITKHVAQILDARYNTEVNEKDKKNRTVKIITLKSNLVSNFRKEFRLYKIREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKRLKTVKTLVGITIMEKATFEKSPIAFLENKGYHNVRKENILCLPKYSLFELKNGRRRMLASAKELQKGNEIVLPVHLTTLLYHAKNIHRLDEPEHLEYIQKHRNEFKGLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 747 - protein, 1371 aa, Streptococcus oralis
MENKNYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLAEEKEYHKQFPTIYHLRKQLADSKEKTDLRLIYLALAHMIKYRGHFLYEDTFDIKNNDIQKIFSEFISIYDNTFEGSSLSGQNAQVEAIFTDKISKSAKRERVLKLFPDEKSTGLFSEFLKLIVGNQADFKKHFDLGEKAPLQFSKDTYDEDLENLLGQIGDDFADLFLVAKKLYDAILLSGILTVTDPSTKAPLSASMIERYENHQKDLAVLKQFIKNNLPEKYDEVFSDQSKDGYAGYIDGKTTQEAFYKYIKNLLSKFEGTDYFLEKIEREDFLRKQRTFDNGSIPHQIHLQEMNAILRRQGEHYPFLKDNKEKIEKILTFRIPYYVGPLARGNRDFAWLTRNSDEAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKEFMDDSKNEEILENIVHTLTIFEDREMIKQRLAQYDSLFDEKVIKALIRRHYTGWGKLSAKLIDGICDKQTGNTILDYLIDDGKNNRNFMQLINDDGLSFKEITQKAQVVGKTDDVKQVVQELPGSPAIKKGILQSIKIVDELVKVMGHTPESIVIEMARENQTTARGKKNSQQRYKRIEDALKNLASGLDSNILKEHPTNNIQLQNDRLFLYYLQNGRDMYTGKPLDINQLSSYDIDHIVPQAFIKDDSLDNRVLTSLKDNRGKSDNVPSIEVVQKRKAFWQQLLDSKLISERKFNNLTKAERGGLDERDKVGFIKRQLVETRQITKHVAQILDARFNKEVNEKDKKNRTVKIITLKSNLVSNFRKEFRLYKVREINDYHHAHDAYLNAVVAKAILKKYPKLEPEFVYGDYQKYDLKRYISRSRNPKEVEKATEKYFFYSNLLNFFKEEVHYADGTIVKRENIEYSKDTGEIAWNKEKDFATIKKVLSYPQVNIVKKREVQTGGFSKESILPKGNSDKLIPRKTKDILWETTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVYLTTLLYHSKNVHKLDEPEHLEYIQKHRNEFKDLLNLVSEFSQKYVLADANLEKIQNLYADNEQADIEILANSFINLLTFTALGAPAAFKFFGKDIDRKRYTTVSEILNATLIHQSITGLYETRIDLSKLGED

SEQ ID NO: 748 - protein, 1121 aa, Streptococcus oralis
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKCRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFVDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKEYELMGLKYSDLSFEKGSGKYSISNEKYNSIKRIEGVNEQSEFKFTLYKNDLILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 749 - protein, 1134 aa, Streptococcus oralis
MNGLVLGLDIGIASVGVGILEKNSGKIVHASSRIFPAATADNNVERRKNRQARRLHRRKKHRGARLKDLFEYYGLLTDFSKVSINLNPYRLRVDGLDQQLTNEELFIALKNIVKRRGISYLDDASEDGGTVSSDYGKAVEENRKLLAEQTPGQIQLERFEKYGQLRGDFTVVENSEKCRLINVFSTSAYKKEAERILRKQQEFNNQITDEFIEDYLKILTGKRKYYHGPGNEKSRTDYGRFRTDGATLDNIFGILIGKCTFYPNEYRASKASYTAQEFNLLNDLNNLTVPTETKKLSEEQKKTIIEYAKSAKTLGASTLLKYIAKMIDASVDQIRGYRVDVNNKPEMHTFEVYRKMQSLETISVGELSRNILDELAHILTLNTEREGIEEAINTKLRDSFSQDQVLELVQFRKNNSSLFSKGWHNFSLKLMMELIPELYETSEEQMTILTRLGKQKSKETSKRTKYIDEKEVTEEIYNPVVAKSVRQAIKIINEATKKHGIFDNIVIEMARENNEEDAKKDYIKRQKANQDEKYAAMEKAAFQYNGKKELPDNIFHGHKELATKIRLWHQQGEKCLYTGKSIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLVDTRYSSRVVLNALQDFYKNHNFDTTISVVRGQFTSQLRRKWGLEKSRETYHHHAVDALIIAASSQLRLWKKQNNPLIAYKEGQFVDSQTGEIISLTDDEYKELVFKAPYDHFVDTLSSKTFEDSILFSYQVDSKFNRKISDATIYATRKAKLDKEKKEYTYTLGKIKDIYSLGTKTPSKTGFYKFLDLYNKDKSQFLMFQKDRKTWDEVIEKIMEQYRPFKEYDKAGKLVDFNPFEKYRQENGPIRKYSKKGNGPEIKSLKYYDILLGKHKNITPEGSRNTVALLSLNPWRTDVYYNMETKKYEFLGLKYADLPFEEGGAYGISTETYNELREKEGIGKNSEFKFTLYKNDLILIKDTETNCQQFFRFWSRTGKDNPKSFEKHKIELKPYEKAKFEKGEELEVLGKVPPSSNQFQKNMQIENLSIYKVKTDVLGNKHFIKKEGDKPKLKF

SEQ ID NO: 750 - protein, 550 aa, Streptococcus oralis
MYSLDKNGSPTPLYRDQLNQYEVDHIIPYSFLPIDSIDNKVLTHRENNQRKLDNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATIRKYLYSNIMRFFNNPDSKVSKDIWDCNRDLPIIKDIIYNSQVNFVKRTMIKKGAFYNQNPVGKFNKQIAANNRYPLKTKVSSLDTSIYGGYGPMNSALSIIIIAERFNEKKCKIETVKEFHDIFIIDYKKFNNDPFQFLNDTSENGFLKKNNINRVLAFYRVPKYSLMQKIDGTRMLFESKSNLHKATQFKLTKTQNELFFHMRRLLTKSNLMDLKSESAIKESQNFILKHKEEFDNISNQLSAFSQKMLGDTTSLKNLIKGYNERKIKEINSSEETIKYFYDNFIKMFSFVKSGAPKDINDFFNNKYTVARMRPKPDKKLLNATLIHQSITGLYETRIDLSKLGED

SEQ ID NO: 751 - protein, 1140 aa, Streptococcus parasanguinis
MNGLVLGLDIGIASVGVGILKKDIGEIIHTNSRLFSAATADSNIERRGHRGGKRLTRRKKHRSIRLHDLFEDFGLLTDFSKVSINLNPYQLRVQGLDNQLTNEELFIALKNIVKRRGISYLDDASEDGGTVSSDYGKAVEENRKLLAEQTPGQIQLDRFEKYGQVRGDFNVVENGEKRRLINVFTTSAYSKEAERILRKQQEFNKKITDEFIEDYLTILTGKRKYYHGPGNEKSRTDYGRYTTKKDPEGKYITLDNIFGILIGKCTFYPDEYRASKASYTAQEFNLLNDLNNLTVPTETKKLSEEQKKTIIKYAKTAKTLGASTLLKYIAKLIGASVDQIHGYRIDPNKKPEMHTFETYRKMQSLETISVEELPRKVLDELAHILTLNTEREGIEEAINATLKDTFSQDQVLELVQFRKNNSSLFSKGWHSFSLKLMMELIPELYETSEEQMTILTRLGKQKSKETSKRTKYIDEKELTEEIYNPVVAKSVRQAIKIINEATKKYGIFDNIVIEMARENNEEDAKKEYIKRQKANLDEKNAAMEKAAFQYNGKKELPDNVFHGHKELATKIRLWHQQGEKCLYTGKNIPISDLIQNQYKYEIDHILPLSLSFDDSLSNKVLVLATANQEKGQRTPFQALDSMDDAWSYREFKSYVKDSKLLGNKKKEYLLTEEDISKIEVKQKFIERNLVDTRYSSRVVLNALQDFYKEHQFDTTISVVRGQFTSQLRRKWGLEKSRETYHHHAVDALIIAASSQLRLWKKQNNPLISYTEGQFVDQVTGEIISLSDDEYKELVFKAPYDHFVDTLKSKKFEDSILFSYQVDSKYNRKISDATIYATRKAKLDKENKEYTYTLGKIKDIYALGTKSPSKTGFYKFLDLYNKDKSQFLMFQKDRKTWDEVIEKIIEQYRPFKEYDENGKEVDFNPFEKYRIENGPIRKYSKKGNGPEIKSLKYYDNLLGKFVDITPSESKNPVALLSLNPWRTDVYYNTETSKYEFLGLKYADLCFEKGGAYGISEVKYNKIREKEGIGKESEFKFTLYKNDLILIKDTETNCQQIFRFWSRTGKDNPKSFEKHKIELKPYEKARFEKGEELEVLGKVPPSSNQLQKNMQIENLSIYKVKTDVLGNKHFIKKEGEEPKLKF

SEQ ID NO: 752 - protein, 1374 aa, Streptococcus pseudoporcinus
MKKRYSYSIGLDIGTNSVGWAVINEDYKVPAKKMTVFGNTDRKTIKKNLLGTVLFDSGETAQARRLKRTNRRRYTRRRYRLCQLQNIFATEMVKVDDTFFQRLSESFFYYQDKAFDKHPIFGNSKEERAYHKTYPTIYHLRKDLADRDQKADLRLIYLALSHIIKFRGHFLIEGKLNSENTDVQKLFIALVTVYNLLFEEEPIAGETCDAKALLTAKTSKSKRLESLISEFPGQKKNGLFGNLLALALGLRPNFKSNFGLSEDAKLQITKDTYEEELDNLLAEIGDHYADLFLAAKNLSDAILLSDILTLSDENTRAPLSASMIKRYEEHQEDLALLKKLVKEQMPEKYWEIFSNAKKNGYAGYIEGKVSQEDFYRYIKPILSRLKGGDEFLAKIDRDDFLRKQRTFDNGSIPHQIHLKELHAILRRQEKYYPFLAEQKEKIEQLLCFRIPYYVGPLAKGGNSSFAWLKRRSDEPITPWNFKDVVDEEASAQAFIEGMTNYDTYLPEEKVLPKHSPLYEMFTVYNELTKVKYIAENMTKPLYLSAEQKEAIIDHLFKQTRKVTVKDLKEKYFSQIEGLENVDVTGVEGAFNASLGTYNDLLKIIKDKAFLDDEANAEILEEIVLILTLFQDEKLIEKRLAKYANLFEKSVLKKLRKRHYRGWGRLSRQLIDGMKDKASGKTILDFLKADDFANRNFIQLINDSSLDFEKLIDDAQKKAIKRESLTEAVANLAGSPAIKKGILQSLKVVDEIVKVMGHNPDNIVIEMSRENQTTAQGLKNARQRLKKIKEVHKKTGSRILEDNSERITNLTLQDNRLYLYLLQDGKDMYTGQDLDINNLSQYDIDHIIPQSFIKDNSIDNLVLTTQKANRGKSDNVPSIEVVRDMKDRVWRRQLANGAISRQKFDHLTKAERGGLADSDKARFLRRQLVETRQITKHVAQLLDSRFNSKSNQNKKLARNVKIITLKSKIVSDFRKDFGLYKLREVNNYHHAHDAYLNAVVGTALLKKYPKLEAEFVYGDYKHFDLVKLISKSDPSLGKATAKVFFYSNIMNFFKEELSLADGTLMKRPVIETNTETGEVVWDKVKDFKTIRKVLSYPQVNIVKKTEIQSGAFSKESVLSKGNSDKLIERKKGWDPKKYGGFDSPNTAYSIFVVAKVAKRKAQKLKTVKEIVGITIMEQAEYEKDNIAFLEKKGYQDIQEKLLIKLPKYSLFELENGRRRLLASANEFQKGNELALSGKYMKFLYLASRYDKLSSKIESEQQKKLFVEQHLHYFDEILDIVVKHATCYIKAENNLKKIISLYKKKEAYSINEQALNMLNLFIFTSLGAPSTFVFFDETIDRKRYTTSSDVLNGILIQQSITGLYETRIDLSRFGGD

SEQ ID NO: 753 - protein, 1052 aa, Streptococcus pyogenes
LSASMIKRYDEHHQDLTLLKALVRQQLPEKYKEIFFDQSKNGYAGYIDGGASQEEFYKFIKPILEKMDGTEELLAKLNREDLLRKQRTFDNGSIPHQIHLGELHAILRRQEDFYPFLKDNREKIEKILTFRIPYYVGPLARGNSRFAWMTRKSEETITPWNFEEVVDKGASAQSFIERMTNFDKNLPNEKVLPKHSLLYEYFTVYNELTKVKYVTEGMRKPAFLSGEQKKAIVDLLFKTNRKVTVKQLKEDYFKKIECFDSVEISGVEDRFNASLGTYHDLLKIIKDKDFLDNEENEDILEDIVLTLTLFEDREMIEERLKTYAHLFDDKVMKQLKRRRYTGWGRLSRKLINGIRDKQSGKTILDFLKSDGFANRNFMQLIHDDSLTFKEDLQKAQVSGQGDSLHEHIANLAGSPAIKKGILQTVKVVDELVKVMGRHKPENIVIEMARENQTTQKGQKNSRERMKRIEEGIKELGSDILKEYPVENTQLQNEKLYLYYLQNGRDMYVDQELDINRLSDYDVDHIVPQSFLKDDSIDNKVLTRSDKNRGKSDNVPSEEVVKKMKNYWKQLLNAKLITQRKFDNLTKAERGGLSELDKAGFIKRQLVETRQITKHVAQILDSRMNTKYDENDKLIREVRVITLKSKLVSDFRKDFQFYKVREINNYHHAHDAYLNAVVGTALIKKYPKLESEFVYGDYKVYDIRKMIAKSEQEIGKATAKYFFYSNIMNFFKTEITLANGEIRKRPLIETNGETGEIVWDKGRDFATVRKVLSMPQVNIVKKTEVQTGGFSKESILPKRNSDKLIARKKDWDPKKYGGFDSPTVAYSVLVVAKVEKGKSKKLKSVKELVGITIMERSSFEKDPVDFLEAKGYKEVRKDLIIKLPKYSLFELENGRKRMLASAGELQKGNELALPSKYVNFLYLASHYEKLKGSPEDNEQKQLFVEQHKHYLDEIIEQISEFSKRVILADANLDKVLSAYNKHRDKPIREQAENIIHLFTLTNLGAPAAFKCFDTTIGRNRYKSIKEVLDATLIHQSITGLYETRIDLSQLGGD

SEQ ID NO: 754 - protein, 1368 aa, Streptococcus pyogenes; identical to SEQ ID NO: 42

SEQ ID NO: 755 - protein, 1367 aa, Streptococcus pyogenes; identical to SEQ ID NO: 246

SEQ ID NO: 756 - protein, 1368 aa, Streptococcus pyogenes [sequence omitted]

SEQ ID NO: 757 - protein, 1370 aa, Streptococcus ratti
MKKPYSIGLDIGTNSVGWAVITDDYKVPAKKMKVLGNTDKNYIKKNLLGALLFDSGNTAEDRRLKRTARRRYTRRRNRLLYLQDIFSDEMNKVDESFFHRLEDSFLVSEDKRGDHHPIFGNVVDEVKYHEQFPTIYHLRKYLADTPEKADLRLVYLALAHMIKFRGHFLIDDPKLDVKNTDSQELFSQFLTAYDVTQEDSHLADVKINISDIITEKMNKSRKVEALLFHFPSQKKNSFFGNLVSLVFGLLPNFKTNFNLAEDAKLQLSKDSYDEDLENLLGQIGDEYTDVFVAARKLYDSILLSGILTVNDLSTKAILSASMVRRYEEHNKDLAKLKAFVKANFTHDVFKEVFSDASKNGYAGYIEGKTSQEDFYKYVKNLIGKVDGSADFIEKIDREDFLRKQRTFDNGSIPHQVHLAEMKAILRRQGEYYPFLKEHAEKIQQILTFRIPYYVGPLDRHGHSDFAWASFNSEEKVTPWNFEEIIDKNKSAQAFIERMTNQDLYLPNEKVLPKHSPLYEKYTVYNELTKIKYVTETGTAKFFDANLKQEIFDGLFKKERKVTKRKLLTFLEKNFDEFRIVDIQGLDKETETFNASYGIYQDLLKIIKDKAFMDDSENADILEDIVLTLTLFEDREMIKQRLAKYADLFDKKVIDNLARRRYTGWGRLSAKLLNGIRDKRSRKTIMDYLVDDGRSNRNLMQLITDDNLTFKDEIAKAQYSDNSDDLHQVVQDLAGSPAIKKGILQSVKIVDELVKVMGYEPEQIVVEMARENQTTAKGRRNSQQRYKRLEEAIKNLDRDLNYKILKEHPTDNQALQNDRLFLYYLQNGRDMYTGESLDINRLSDYDIDHIIPQAFIKDNSIDNRVLVSSAKNRGKSDDVPSEDVVNRMRPFWNKLLNCGLISQRKYSNLTKKELTPNDKAGFIKRQLVETRQITKHVARILDEHFNKEFDEDKKRIRKVKVVTLKSNLVSNFRKEFELYKVREINDYHHAHDAYLNAVVAKALLMKYPKLEPEFVYGEYPKYNSYRERKTATQRMFFYSNIMNMFKSKVKLADERIIERPMIEVNDETGEIAWDKTKHIATVKKVLSYPQINIVKKVEEQTGGLTNETIYPRGSFDKLLNRKNTLEASKYGGFGSPTVAYCVLVVADSKNENGKVKKLKLGSELLGITILEKNDFENNSLDFLSRKGYQGVQEKKIIKLPKYSLFEFQDGSRRMLSSVMANDNKRGDLQKANEMILPAYLVKLLYHAKHINSVGEPAHKNYINEHCSEFQDLLNYIRQFADKFVDVDKNLSKIRSLSKSMAEYSVSEICSSFVNLLTLTALGAPADFKFFGTTIPRKRYGSPQSILSATLIHQSITGLYETRIDLSKLGED

SEQ ID NO: 758 - protein, 1135 aa, Streptococcus salivarius
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLACDIADIKGYRIDKSDKAEIHTFEAYRKMKTLETIDIEQIEREKLDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFKAHKIDTKVSVVRGQFTSQLRRHWGIDKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYALGTKTPSKTGFYKFLDLYNKDKSQFLVYQKDRKTWDEVIEKIMEQYRPFKESDKNGKEVDFNPFEKYRIENGPIRKYSRKGNGPEIKSLKYYASKLGNHIDITPKDSNNKVVLQSVSPWRADVYFNKTTGSYEILGLKYADLQFEKGTGTYRISEEKYNDIKKKEGVDSDSEFKFTLYKNDLLLIKDTETKEQRLFRFLSRSMPNKKHYVELKPYSKDKFEKNESLIEILGSADKSGRCIKGLAKSNLSIFKVRTDVLGNQHIIKNEGDKPKLDF

SEQ ID NO: 759 - protein, 1127 aa, Streptococcus salivarius
MSDLVLGLDIGIGSVGVGILNKVTGEIIHKNSRIFPAAQAENNVERRINRQGRRLTRRKKHRRVRLNHLFEESGLITDFTNVSINLNPYQLRVKGLTDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNPQITDEFINSYLQILTGKRKYYHGPGNEKSRTDYGRYTTKKDSEDEYITLDNIFGILIGKCTFYPEEYRAAKASYTAQEFNLLNDLNNLTVPTETKKLSEEQKNQIITNVKNEKAMGPAKLFKYIAKLLSCDVADIKGYRIDKSDKAEIHTFEAYRKMKTLATIDIEQMERENLDKLAYVLTLNTEKEGIQEALEHEFADGTFSQEQIDELVQFRKANSSIFGKGWHSFSVKLMMELIPELYATSEEQMTILTRLGKQKTTSSSNKTKYIDEKQLTEEIYNPVAAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEIDHILPLSITFDDSLANKVLVYATANQEKGQRTPYQALDSMDDAWSFRELKAFVRDSKALSNKKKEYLLTEEDISKFDVRKKFIERNLVDTRYASRVVLNALQEHFRVHKTDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYSQTGYDAFIKIYKKDKSKFLMYRHDPQTFEKVIEPILENYPNKELNEKGKEVPCNPFLKYKEDHGYIRKYSKKGNGPEIKSLKYYDSKLGNHIDITPKNSNNKVVLQSVSPWRADVYFNKTTGKYEILGLKYADLKFEKGTGTYKISEEKYNDIKIKEGVDSDSEFKFTLYKNDLLLIKDTETKEQQLFRFLSRTMPNVKHYVELKPYDKQKFDDNEELIKILGIVAKGGQCKKGVSKPNISIYKIRTDVLGNQHIIKNEGDKPKLDF

SEQ ID NO: 760 - protein, 1385 aa, Streptococcus salivarius
MTKPYSIGLDIGTNSVGWAVITDDYKVPSKKMKVLGNTSKKYIKKNLLGALLFDSGITAEGRRLKRTARRRYTRRRNRILYLQEIFSTEMATLDDAFFQRLDDSFLVPDDKRDSKYPIFGNLVEEKVYHDEFPTIYHLRKHLADSSKKADLRLVYLALAHMIKYRGHFLIEGDFNSKNNDLQKNFQDFLDTYNAIFESDLSLENSKQLEEIVKDKISKSAKKDRILKLFPGEKNSGIFSEFLKLIVGNQADFRKYFNLDEKTSLQFSKESYDEDLETLLGHIGDDYSDVFLKAKKLYDAILLSGILTVTDNGTEAPLSSAMIMRYKEHEEDLALLKAYIRNISLETYNEVFKDNTKNGYAGYIDGKTSQEDFYVYLKRLLAGLEGADYFLEKIDREDFLRKQRTFDNGSIPYQIYLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYENFTVYNELTKVRFIAEGMRDYQFLDSKQKKDIVRLYFKGKRKVTDKDIIEYLHAIDGYDGIELKGIEKQFNSSLSTYHDLLNIINDKEFLDDSSNETIIEEIIHTLTMFEDREMIKQRLSKFDNIFDKSVLKKLSRRHYTGWGKLSAKLINGIRDEKSGNTILDYLIDDGVSNRNFMQLIHDDALSFKKKIKKAQIIGDKDNIKQVVKSLPGSPAIKKGILQSIKIVDELVKVMGREPESIVVEMARENQYTNQGKSNSQQRLKRLEESLKGLGSKILKENVPTRLSKIDNNALQNDRLYLYYLQNGKDMYTGEELDIDRLSNYDIDHIIPQAFLKDDSIDNKVLVSSASNRGKSDDVPSLEVVKKRKTLWYQLLKSKLISQRKFDNLTKAERGGLSQEEKAGFIQRQLVETRQITKHVARLLDERFNNKKDENNRTLRTVKIITLKSSLVSQFRKDFELYKVREINDFHHAHDAYLNAVVASALLKKYPKLEPEFVYGDYPKYNSFRERKSATEKVYFYSNIMNIFKKSIPLADGTVIDRPLIEVNEETGESVWNKVADLNTVRKVLSYSQVNIVKKVEEQNHGLDRGKPKGLFNANLSSKPKPNSKENLVGAKEYLDPKKYGGYAGISNSFAILVKGTIEKGAKKKITNVLEFQGISILDRIYYRKDKLNFLLEKGYKDIELIIELPKYSLFELSDGSRRMLASILSTNNKRGEIHKGNQIFISQKFVKLLYHAKRISSTFNENHRKYVENHKKEFEELFYYILEFNENYVGAKKNGELLKSAFQSWQNHSIDELCSSFIGPTGSERKGLFELTSRGGAADFEFLGVKIPRYRDYTPSSLLKDATLIHQSVTGLYETRIDLGKLGED

SEQ ID NO: 761 - protein, 1392 aa, Streptococcus sanguinis
MENKNYSIGLDIGTNSVGWAVITDDYKVPSKKMKVFGNTDKHFIKKNLIGALLFDEGATAEDRRLKRTARRRYTRRKNRLRYLQEIFSEEISKLDSSFFHRLDDSFLVPKDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSAKRERVLKLFSDEKSTSLFSEFLKLIVGNQADFKKHFDLEEKAPLQFSKDTYDEDLENLLGQIGDGFTDLFLVAKKLYDAILLSGILTVTDPSTKAPLSASMIERYESHQKDLAALKQFIKNNLPKRYNEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARGNRDFAWLTRNSDQAIRPWNFEEIVDKASSAEEFINKMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNASLSTYHDLLKIIKDKEFMDDPKNEEILENIVHTLTIFEDREMIKQRLAQYDSIFDEKVIKALTRRHYTGWGKLSAKLINGICDKQTGDTILDYLIDDGKINRNFMQLINDDGLSFKEIIQKAQVVGKTDDVKQVVQELPGSPAIKKGILQSIKIVDELVKVMGYAPESIVIEMARENQTTARGKKNSQQRYKRIEDSLKNLAPGLDSNILKENPTDNIQLQNDRLFLYYLQNGKDMYTGKPLDIDQLSSYDIDHIIPQAFIKDDSIDNRVLTSSKDNRGKSDNVPSLEVVQKRKAFWQQLLDSKLISERKFNNLTKAERGGLDERDKVGFIRRQLVETRQITKHVAQILDASFNTEVNEKNQKIRTVKIITLKSNLVSNFRKEFELYKVREINDYHHAHDAYLNAVVAKAILKKYPKLEPEFVYGDYQKYDLKRYISRFKPSKEIEKATEKYFFYSNLLNFFKEEVHYADGIIVKRENIEYSKDTGEIAWNKEKDFATIKKVLSYPQVNIVKKTEIQTHGLDRGKPKGLFNSNPSPKPSEDSKENLVPIKQGLDPRKYGGYAGISNSYAVLVKAIVEKGAKKQQKTILEFQGISILDKINFENNKENYLLKKRYIEILSTITLPKYSLFEFPDGTRRRLASILSTNNKRGEIHKGNELVLPGKYTTLLYHAKNINKKLEPEHLEYVEKHRNDFAKLLECVLNFNDKYVGALKNGERIRQAFTDWETVDIEKLCFSFIGPENSKNAGLFELTSQGSASDFEFLGVKIPRYRDYAPSSLLKATLIHQSITGLYETRIDLSKLGED

SEQ ID NO: 762 - protein, 1377 aa, Streptococcus sanguinis
MKKPYSIGLDIGTNSVGWAVITDDYKVPSKKMKVLGNTDKHFIKKNLIGALLFDEGTTAEDRRLKRTSRRRYTRRKNRLRYLQEIFSEEISKLDSSFFHRLDDSFLVPEDKRGSKYPIFATLEEEKEYHKKFPTIYHLRKHLADSKEKTDLRLIYLALAHMIKYRGHFLYEESFDIKNNDIQKIFNEFISIYDNTFEGSSLSGQNAQVEAIFTDKISKSTKRERVLKLFSDEKSTGLFSEFLKLIVGNQADFKKHFDLEEKAPLQFSKDTYDEDLENLLGQIGDGFADLFLVAKKLYDAILLSGILTVTDPSTKAPLSASMIERYENHQEDLAALKQFIKNNLSEKYAEVFSDQSKDGYAGFIDGKTTQEAFYKYIKNLLSKLEGADYFLNKIEREDFLRKQRTFDNGSIPHQIHLQEMNAILRRQGEHYLFLKENREKIEKILAFRIPYYVGPLARGNRDFAWLTRNSDQAIRPWNFEEVVDKASSAEDFINKMTNYDLYLPEEKVLPKHSLLYETFAVYNELTKVKFIAEGLRDYQFLDSGQKKQIVNQLFKDKRKVTEKDIIHYLHNVDGYDGIELKGIEKQFNASLSTYHDLLKIIKDKEFMDNPKNGEILENIIHTLTIFEDREMIKQRLAQYDTLFDEKVIKALTRRHYTGWGKLSAKLINGIRDKQTGKTILEYLIDDGDCNRNFMQLINDDGLSFKEIIQKAQVVGKTDDVKQVVQEIPGSPAIKKGILQSIKIVDELVKVMGHNPESIVIEMARENQTTAKGKKNSQQRYKRIEDALKNLAPGLDSNILKENPTDNIQLQNDRLFLYYLQNGKDMYTGKAIDINQLSNYDIDHIIPQAFIKDDSLDNRVLTSSKDNRGKSDNVPSIEVVQKRKAFWQQLLDSKLISERKFNNLTKAKRGGLDERDKVGFIKRQLVETRQITKHVAQLLDTRFNTEVNEENQKIRTVKIITLKSNLVSNFRKEFGLYKVREINDYHHAHDAYLNAVVAKAILKKYPKLEPEFVYGDYQKYDLKRYILKSKASNTIDKATEKYFFYSNLLNFFKEKVRYADGTIKKRENIEYSNDTGEIAWNKEKDFATIKKVLSLPQVNIVKKTEEQTVGQNGGLFDNNIVSKKKVVDASKLIPIKSSLSPEKYGGYARPTIAYSVLVIADIEKGKGKAKKLKRIKEIVGITIQDKKKFESNPVTYLEECGYKNINSNLIIKLPKYSLFEFNDGQRRLLASSIELQKGNELILPYHLTALLYHAQRINKISEPIHKQYVEAHQNEFKELLTTIISLSKKYIQKPNVELLLQQAFDQADKDIYQLSESFISLLKLTSFGAPGAFKFLGVEISQSSVRYKPNSQFLDTTLIHQSITGLYETRIDLSKLGED

SEQ ID NO: 763 - protein, 1370 aa, Streptococcus sanguinis
MKKPYSIGLDIGTNSVGWAVVTDDYKVPAKKMRVFGDTDRSHIKKNLLGTLLFDDGNTAESRRLKRTARRRYTRRRNRILYLQEIFTESMNEIDESFFHRLDDSFLVPEDKRGSKYPIFATLQEEKEYHKQFPTIYHLRKQLADSKEKSDVRLIYLALAHMIKYRGHFLYEETFDIKNNDIQKIFNEFINIYDNTFEGSSLSGQNAQVEAIFTDKISKSAKRERVLKLFPDEKSTGLFSEFLKLIVGNQADFKKHFDLEEKAPLQFSKDTYDEELENLLGQIGDDFADLFLIAKKLYDAILLSGILTVTDPSTKAPLSASMIERYENHQKDLAALKQFIKNNLPEKYVEVFSDQSKDGYAGYIDGKTTQEAFYKYIKNLLSKFEGADYFLDKIEREDFLRKQRTFDNGSIPHQIHLQEMNAILRRQGEHYPFLKENREKIEKILTFRIPYYVGPLARDNRDFSWLTRNSDEPIRPWNFEEVVDKARSAEDFIHRMTNYDLYLPEEKVLPKHSLLYETFAVYNELTKVKFIAEGLRDYQFLDSGQKKQIVNQLFKEKRKVTEKDIIHYLHNVDGYDGIELKGIEKQFNANLSTYHDLLKITKDKEFMDDPKNEEILENIVHTLTIFEDREMIKQRLAQYDTLFDEKVIKALTRRHYTGWGKLSAKLINGIRDKQSGKTILDYLIDDDKINRNFMQLINDDGLSFKEIIQKAQVVGKTDDVKQVVQELPGSPAIKKGILQSIKIVDELVKVMGYALESIVIEMARENQTTARGKKNSQQRYKRIEDALKNLAPGLDSNILKENPTDNIQLKNDRLFLYYLQNGKDMYTGKPLDINQLSSYDIDHIIPQAFIKDDSIDNRVLTSSKDNRGKSDNVPSLEVVQKRKAFWQQLLDSKLISERKFNNLTKAERGGLDERDKVGFIRRQLVETQQITKNVAQILDARFNTEVKEKNQKIRTVKIITLKSNLVSNFRKEFGLYKVREINNYHHAHDAYLNAVVAKAILKKYPKLEPEFVYGDYQKYDLKKYISRFKPSKEIEKATEKYFFYSNLLNFFKEEVLYADGTIRKRENIEYSKDTGEIAWDKEKDFATIKKVLSYPQVNIVKKREVQTGGFSKESILPKGNSDKLIPRKTKDILWDTTKYGGFDSPVIAYSILLIADIEKGKAKKLKTVKTLVGITIMEKAAFEENPITFLENKGYHNVRKENILCLPKYSLFELENGRRRLLASAKELQKGNEIVLPVCLTTLLYHSKNLHKLDEPEHLEYIQKHRNEFKDLLNLVSEFSQKYILAEANLEKIKDLYADNEQADIEILANSFINLLTFTALGAPAAFKFFGKDVDRKRYTTVSEILNATLIHQSITGLYETRIDLSKLGEE

SEQ ID NO: 764 - protein, 1421 aa, Streptococcus sanguinis
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 765 - protein, 317 aa, Streptococcus sp.
FEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 766 - protein, 1420 aa, Streptococcus sp.
MAKFNKNYSIGLDIGVSSVGYAVVTEDYRVPAFKFKVLGNTEKEKIKKNLIGSTTFVPAQSAQGTRVFRVNRRRIDRRNHRIAYLRDIFQKEIEKIDKNFYRRLDESFRVLGDKSEDIQIKQPFFGNKELETAYHKKYPTIYHLRKHLADADKNSPVADIREVYMVLSHILKYRGHFLTLGKIDPNNINMQNSWIDFIESCQDAFDLEISDESKTIAAIFKSSENRQEKVKQILSYFQQELLKKDKSIFKQLLQLLFGLKTKFKDCFELEEEPDLNFSKENYDENLENLLGALEEDFSDVFAKLKILRDTILLSSMLTYTGATHARFSATMVERYEEHRKDLQRFKSFVKQNLSEQDYLDIFGRKTPTGFDVDKETKGYVGYISNKMVLTNPQKQKTIQQNFYDYISGKITGIEGAECFLNKISDGTFLRKLRTTDNGAIPNQIHAYELEKIIERQGRDYPFLLENKDKLLSILTFKIPYYVGPLAKGNNSRFAWIKRTTSQDVLDDNDEDTRNGKIRPWNYHKLINMDETRDAFIINLIGNDIILLNEKVLPKRSLIYEEVMLQNELTRVKYKDKYGKIHFFNSELRQEIINNLFKTNSKRVSSAMLLSYLENFTNLQAVEIVSGIEKGKSLNSTLKTYNDLKTIFSEELLDSEIYQKELEEIIKVITVFDDKKSIKNYLTKYFGHLEFLNEEKINQLSKLRYTGWGRYSGKLLLGIRDEDTGFNLMQFLRNDDENRNLTQLISDTTLSFDSAIKAIQSKSTVEDDVFEEIKNLAGSPAIKRGILNSIKIVDELVQIIGYPPQNIIIEMARENMTTEEGQKKAKTRKSKLESALKNIEDSVLESGKVPHSDEQLQSEKLYLYYLQNGKDMYSLDKTGSPTPLYRDQLDQYEVDHIIPYSFLPIDSIDNKVLTHRENNQRKLNNIPDKETVANMKPFWEKLYNAKLISQTKYQRLTTSERTPDGVLTESMKAGFIERQLVETRQIIKHVARILDNRFSDTKIITLKSQLVTNFRNTFHIAKIRELNDYHHAHDAYLAVVVGQTLLKAYPKLAPELIYGHHAHFNRHEENKATLRKHLYSNIMRFFNNPDSKVSKDIWDCNRDLPIVKDVIYNSQINFVKRTMIKKGAFYNQNPVGKLNKQIAANNRYPLKTKVSSLDTSIYGGYGPMNSALSIIIIAERFNEKKGKIETVKEFHDIFIIDYEKFNNNPFQFLNNVSEEGFLKKNDLNRVLAFYRISKYSLMQKIDGTRMLFESKSNLHKVTQFKLTKTQNELFFHMKRLLTKSNLMDLKSESAIKESQNFIQTHQNEFDNIADRLSNYSQKMLGETKSLQTLINGYNERPIKQIDNNEETIRYYYDNFIKMFSFVKSGAPKDIINFFNDKYTVPRMRPKPDRKMLDATLIHQSITGLYETRIDLSKLGED

SEQ ID NO: 767 - protein, 1371 aa, Streptococcus sp.
MENKNYSIGLDIGTNSVGWSVITDDYKVPSKKMKVLGNTDKHFIKKNLIGALLFDEGTTAEARRLKRTARRRYTRRKNRLRYLQEIFSEEIGKVDSSFFHRLDDSFLIPEDKRGSKYPIFATLAEEKKYHKQFPTIYHLRKQLADSKEKTDLRLIYLALAHMIKYRGHFLYEEAFDIKNNDIQKIFNEFISIYNNTFEGNSLSGQNVQVEAIFTDKISKSAKRERVLKLFPDEKSTGLFSEFLKLIVGNQADFKKHFDLEEKAPLQFSRDTYDEDLENLLGQIGDDFADLFLVAKKLYDAILLSGILTVTNPSTKAPLSASMIERYENHQKDLASLKQFIKNNLPEKYDEVFSDQSEDGYAGYIDGKTTQETFYKYIKNLLSKFEGADYFLDKIEREDFLRKQRTFDNGSIPHQIHLQEMNAILRRQGEHYPFLKENKEKIEKILTFRIPYYVGPLARGNRDFAWLTRNSDQAIRPWNFEEIVDKASSAEDFINKMTNYDLYLPEEKVLPKHSLLYETFAVYNELTKVKFIAEGLRDYQFLDSGQKKQIVTQLFKEKRKVTEKDIIQFLHNVDGYDGIELKGIEKQFNASLSTYHDLLKIIKDKAFMDDAKNEAILENIVHTLTIFEDREMIKQRLAQYDSLFDEKVIKALTRRHYTGWGKLSAKLINGISDKQTGNTILDYLIDDGEINRNFMQLINDDGLSFKEIIQKAQVVGKTNDVKQVVQELPGSPAIKKGILQSIKIVDELVKVMGHAPESIVIEMARENQTTARGKKNSQQRYKRIEDSLKILASGLNSKILKEHPTDNIQLQNDRLFLYYLQNGKDMYTGEALDINQLSSCDIDHIIPQAFIKDDSLDNRVLTSSKDNRGKSDNVPSLEVVDKMKVFWQQLLDSKLISYRKFNNLTKAERGGLNELDKVGFIKRQLVETRQITKHVAQILDARFNKEVTEKDKKNRTVKIITLKSNLVSNFRKEFELYKVREINDYHHAHDAYLNAVVAKAILKKYPKLEPEFVYGDYQKYDLKRYISRSKDPKEIEKATEKYFFYSNLLNFFKEEVHYADGTIVKRENIEYSKDTGEIAWNKEKDFATIKKVLSLPQVNIVKKREVQTGGFSKESILPKGNSDKLIPRKTKDILWDTTKYGGFDSPVIAYSILLIADIEKGKAKKLKTVKTLVGITIMEKDAFEKNPIAFLENKGYHNVCKENILCLPKYSLFELENGRRRLLASAKELQKCNEIVLPVYLTTLLYHSKNVHKLDEPGHLEYIQKHRNEFKDLLNLVSEFSQKYVLADANLEKIKNLYADNEQADIEILANSFINLLTFTALGAPAAFKFFGKDVDRKRYTTVSEILNATLIHQSITGLYETRIDLSKLGED

SEQ ID NO: 768 - protein, 93 aa, Streptococcus sp.
MILIKDSENNEQKLFRFNSRNDTAKHYVELKPYDKARFDGQQELITILGNVAKGGQCLKGLNKSNISIFKVKTDVLGKKHIIKKEGDEPKLKF

SEQ ID NO: 769 - protein, 1121 aa, Streptococcus sp.
MNGLVLGLDIGIASVGVGILEKNSGKIIHANSRLFPAATADNNVERRKNRQARRLHRRKKHRGVRFQDLFEDYGLLTDFSKVSINLNPYRLRVDGLNQQLTNEELFIALKNIVKRRGISYLDDASEDGGTVSSDYGKAVEENRKLLAEQTPGQIQLERFEKYGQVRGDFTVVENGEKRRLINVFSTSAYRKEAERILRKQQEFNSKITDEFIEDCLKILTGKRKYYHGPGNEKSRTDYGRFRTDGTTLDNIFGILIGKCTFYPDEYRASKASYTAQEFNLLNDLNNLTVPTETKKLSEEQKKVIVEYAKEAKTLGASTLLKYIAKMIDASVDQIRGYRVDVNNKPEIHTFEAYRKMQSLETISVGELSRNVLDELAHILTLNTEREGIEEAINTKLKDSFSQDQVLELVQFRKNNSSLFSKGWHNFSLKLMMELIPELYETSEEQMTILTRLGKQKSKEISKRTKYIDEKELTEEIYNPVVAKSVRQAIKIINEATKKHGIFDNIVIEMARENNEEDAKKDYIKRQKANQDEKNAAMEKAAFQYNGKKELPDSIFHGQKELATKIRLWHQQGEKCLYTGKNIPISDLIHNQYKYEIDHILPLSLSFDDSLSNKVLVLATANQEKGQRTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATRKAKLDKEKSEETYVLGKIKDIYSQAGYDAFIKIYNKDKSKFLMYHKDPQTFEKVIEEILRTYPSKELNDKNKEIPCNPFEKYRQENGPIRKYSKKSNGPEIKSLKYYDNKLGNHIDITPESSDNQVVLQSLKPWRTDVYFNHQTKKYELMGLKYSDLSFEKGSGKYSISNQKYNSIKRIEGIDEQSEFKFTLYKNDLILIKDSENNEQKLFRFNSRNDTAKHYIELKPYDKAKFDGEQELITILGNVAKGGRCLKGLNKSNISIFKVKTDVLGKKHIIKKEGDEPKLKF

SEQ ID NO: 770 - protein, 1026 aa, Streptococcus sp.
MNGLVLGLDIGIASVGVGILEKNSGKIIHANSRLFPAATADNNVERRKNRQARRLNRRKKHRGVRFQDLFEDYGLLTDFSKVSINLNPYRLRVDGLNQQLTNEELFIALKNIVKRRGISYLDDASEDGGAVSSDYGKAVEENRKLLAEQTPGQIQLERFEKYGQVRGDFTVVENGEKRRLINVFSTSAYRKEAEKILRKQQEFNNQITDEFIEDYLKILTGKRKYYHGPGNEKSRTDYGRFRTDGTTLDNIFGVLIGKCTFYPNEYRASKSSYTAQEFNLLNDLNNLTVPTETKKLSEEQKKVIVEYAKEAKTLGASTLLKYIVKMIDASVDQISGYRVDVNNKPEMHTFEVYRKMQSLETISVGELSRNVLDELAHILTLNTEREGIEEAINSKLMGVFSQDQVLELVQFRKNNSSLFSKGWHNFSLKLMMELIPELYETSEEQMTILTRLGKQKSKETSKRTKYIDEKELTEEIYNPVVAKSVRQAIKIINEATKKHGIFDNIVIEMARENNEEDAKKDYIKRQKANQDEKNAAMEKAAFQYNGKKELPGNIFNGHKELATKIRLWHQQGEKCLYTGKTIPISDLIHNQYKYEIDHILPLSLSFDDSLSNKVLVHATANQEKGQRTPFQALDSMDDAWSYREFKSYVKDLKSLSNKKKDYLLTEEDISKIEVKQKFIERNLVDTRYSSRVVLNALQDFYKSHQFDTTISVVRGQFTSQLRRKWGLEKSRETYHHHAVDALIIAASSQLRLWKKQNNPLITYKEGQFIDSQTGEIISLTDDEYKELVFKAPYDHFVDTLHSKTFEDGILFSYQVDSKYNRKISDATIYATRKAKLDKDKSEETYVLGKIKDIYSQAGYDAFIKIYNKDKRKFLMYHKDPQTFEKVIEEILRTYPSKERNDKNKEVPCNPFEKYRQENGPIRKYSKKGNGPEIKCLKYYDNKLGNYIDISPDGSDNQVVLQSLKPWRTDVYFNHQTKKYELMGLKYSDLSFEKGSGKYSISNEKYNSIKRIEGVNEQSEFKFTLYK

SEQ ID NO: 771 - protein, 1377 aa, Streptococcus sp.
MNNKPYSIGLDIGTNSVGWSVITDDYKVPSKKMKVLGNTDKRFIKKNLIGALLFDEGTTAEARRLKRTARRRYTRRKNRLRYLQEIFAEEMSKVDSSFFHRLDDSFLIPEDKRGSKYPIFATLVEEKEYHKQFPTIYHLRKQLADSKEKADLRLIYLVLAHMIKYRGHFLYEEAFDIKNNDIQKIFNEFISIYDNTFEGSSLSGQNAQVETIFTDKISKSAKRERVLKLFPDEKSTGLFSEFLKLIVGNQADFKKHFDLEEKAPLQFSKDTYDEDLENLLEQIGDDFADLFVAAKKLYDAILLSGILTVTDPSTKAPLSASMIERYENHQKDLAVLKQFIKTNLPEKYVEVFSDQSKDGYAGYIDGKTTQEAFYKYIKNLLSKFDGADYFLDKIEREVFLRKQRTFDNGSIPHQIHLQEMNTILRRQGEHYPFLKENKEKIEKILTFRIPYHVGPLARGNRDFAWLTRNSDQAIRPWNFEEIVDKASSAEDFINKMTNYDLYLPEEKVLPKHSLLYETFAVYNELTKVKFIAEGMRDYQFLDSGQKKKIINQLFKKKRKVTEDDIIDCLQKIDNYDGIELKGIEKQFNASLSTYHDILKIIRDKEFMDDPKNGDILENVIHTLTIFEDREMIKQRLAQYNSIFDEKVIKALSRKHYTGWGKLSAKLIDGIRDKQTGKTILDYLMDDGKSNRNFMQLIKDDELSFTEIIQKAQVVGDTDNLRQVVQNLPGSPAIKKGILQSIKIVDELVKVMGHAPESIVIEMARENQTTARGKKNSQQRYKRIEDSLKNLASGLDSNILKENPTDNIQLQNDRLFLYYLQNGKDMYTGEALNINQLSSYDIDHIIPQAFIKDDSLDNRVLTSSKDNRGKSDNVPSLEVVEKMKAFWQQLLDSKLISERKYNNLTKAERERGGLNELDKVGFIKRQLVETRQITKHVAQILDARFNKEVTEKNKKNRNVKIITLKSNMVSNFRKEFGLYKVREINDYHHAHDAYLNAVVAKAILKKYPKLEPEFVYGDYQKYDLKRYISRSKDPKEVEKATEKYFFYSNLLNFFKEEVHYADGTIVKRENIEYSKDTGEIAWNKEKDFATIKKVLSLPQVNIVKKTEEQTVGQNGGLFDNNIVSKKKVVDASKLIPIKSGLSPEKYGGYARPTIAYSVLVTYKQNNKIKNTMVGIPVLTKLEFERDPNLYLRNLGINNVSHVIKLVKYTVLEFKHKYGTYRRFIVSNQELKRANQIFVTTKQMKLISQYTTLDKNEHDSLLKNNQQLIQSIWNQFLEFMLATDLVNKKQYDELILTNNQTIEECRNIMNRVITTLSFTNINAGQKKIIFDDTLSLPIKRWQFTDSDKMVKKIIESTLIHQSITGLYETRIDLSKLGED

SEQ ID NO: 772 - protein, 1371 aa, Streptococcus sp.
MNNNNYSIGLDIGTNSVGWAVITDDYKVPSKKMRVLGNTDKRFIKKNLIGALLFDEGTTAEDRRLKRTARRRYTRRKNRLRYLQEIFAEEMSKVDSSFFHRLDDSFLVPEDKSGSKYPIFATLAEEKEYHKKFPTIYHLRKHLADSKEKADLRLIYLALAHITKYRGHFLYEEAFDIKNNDIQKIFNEFINIYDNTFEGSSLSGQNAQVEAIFTGKISKSVKREHVLKLFPDEKSTGLFSEFLKLIVGNQADFKKHFDLEEKASLQFSKDTYDEDLENLLGQIGDDFADLFLVAKKLYDAILLSGILTVTDPSTKAPLSASMIERYENHQEDLAALKQFIKNNLPEKYAEVFSDQSKDGYAGYIDGKTTQEAFYKYIKNLLSKFEGADYFLDKIEREDFLRKQRTFDNGSIPHQIHLQEMNAILRRQGEHYPLLKENKEKIEKILTFRIPYYVGPLARGNRDFAWLTRNSDQAIRPWNFEEIVDKASSAESFINKMTNYDLYLPEEKVLPKHSLLYETFAVYNELTKVKFIAEGLRDYQFFDSGQKKQIVNQLFKEKRKVTEKDIIHYLHNVDGYDGIELKGIEKQFNASLSTYHDLLKIIKDKEFMDNHKNQEILENIVHTLTIFEDREMIKQRLAQYDSIFDEKVIKALTRRHYTGWGKLSAKLINGICDKKTGKTILDYLIDDGYNNRNFMQLINDDGLSFKEIIQKAQVVGKTDDLTQVVRELSGSPAIKKGILQSIKIVDELVKIMGYAPESIVIEMARENQTTAKGKKNSQQRYKRIEDALKNLAPGLDSTISKENPTDNIQLQNDRLFLYYLQNGKDMYTGEALDINQLSSYDIDHIIPQAFIKDDSLDNRVLTSSKDNRGKSDNVPSLEVVKKRKAFWQQLLDSKLISERKFNNLTKAERGGLDERDKVGFIKRQLVETRQITKHVARILDARFNTEVSEKNQKIRSVKIITLKSNLVSNFRKEFKLYKVREINDYHHAHDAYLNAVVAKAILKKYPKLEPEFVYGDYQKYDLKRYISKSKDPKEVEKATEKYFFYSNLLNFFKEEVHYADGTIVKRENIEYSKDTGEIAWNKEKDFVTIKKVLSYPQVNIVKKREVQTGGFSKESILPKGNSDKLIPRKTKDILWDTTKYGGFDSPVIAYSILLIADIEKGKAKKLKTVKTLVGITIMEKAAFEKNPITFLENKGYHNVRKENILCLPKYSLFELENGRRRLLASAKELQKGNEIVLPVYLTTLLYHSKNVHKLDEPEHLEYIQKHRYEFKDLLNLVSEFSQKYVLAEANLEKIKSLYVDNEQADIEILANSFINLLTFTALGAPAAFKFFGKDVDRKRYTTVSEILNATLIHQSITGLYETRIDLSKLGED

SEQ ID NO: 773 - protein, 1139 aa, Streptococcus sp.
MSDLVLGLDIGIGSVGVGILNKVTGEIIHKNSRIFPAAQAENNLERRTNRQGRRLTRRKKHRRVRLNHLFEESGLITDFTKVSINLNPYQLRVKGLTAELSNEELFIALKNMVKHRGISYLDDASDDGNSSVGDYAQIVKENSKQLETKTPGQIQLERYQKYGQLRGDFTVEEDGRKHRLINVFPTSAYHAEALRILQTQQEFNPQITDEFINSYLEILTGKRKYYHGPGNEKSRTDYGKYTTKKDAQGQYITLNNIFGILIGKCTFYPEEYRAAKASYTAQEFNLLNDLNNLTVPTETKKLSEEQKYQIITYVKNEKAMGPAKLFKYIAKLLSCDVADIKGYRIDKSDKAEIHTFEAYRKMKTLETLDVKKMAREELDKLAYVLTLNTEREGIQEALDHEFADGTFSQEQVDELVQFRKANSSIFGKGWHSFSVKLMMELIPELYATSEEQMTILTRLGKQKTTSSSNKTKYIDEKQLTEEIYNPVVAKSVRQAIKIVNAAIKKYGDFDNIVIEMARETNEDDEKKAIQKIQKANKAEKDAAMRKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKALSNKKKEYLLTEEDISKFDVRKKFIERNLVDTRYASRVVLNALQEHFRTHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKDKSQFLMYQKDRRTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQIFRFWSRTGKDNPKSFEKHKLELKPYEKTRFEKGEELKVLGKVPPSSNRLQKNMQIENLSIYKVRTDVLGNQHIIKNEGDKPKLDF

SEQ ID NO: 774 - protein, 1375 aa, Streptococcus sp.
MSNKSYSIGLDIGTNSVGWAVITDDYKVPSKKMKVLGNTDKHFIKKNLIGALLFDEGTTAEDRRLKRTARRRYTRRKNRLRYLQEIFSQEISKVDSSFFHRLDDFFLVPEDKRGSKYPIFATLVEEKEYHKKFPTIYHLRKHLADSKEKTDLRLIYLALAHMIKYRGHFLYEESFDIKNNDIQKIFSEFISIYDNTFEGKSLSGQNAQVEAIFTDKISKSTKRERVLKLFPDEKSTGLFSEFLKLIVGNQADFKKHFDLEEKAPLQFSKDTYDEDLENLLGQIGDDFADLFLVAKKLYDAILLSGILTVKDLSTKAPLSASMIERYENHQKDLAALKQFIQNNLQEKYDEVFSDQSKDGYAGYIDGKTTQEAFYKYIKNLLSKFEGADYFLDKIEREDFLKKQRTFDNGSIPHQIHLQEMNAIIRRQGEHYPFLQENKEKIEKILTFRIPYYVGPLARGNGDFAWLTRNSDQAIRPWNFEEIVDQASSAEDFINKMTNYDLYLPEEKVLPKHSLLYETFAVYNELTKVKFIAEGLTRYQFLDKKQKKDIFDTFFKAENKRKVTEKDIIHYLHNVDGYDGIELKGIEKQFNASLSTYHDLLKIIKDKAFMDDSKNEEILENIIHTLTIFEDREMIKQRLAQYDSLFDEKVIKALTRRHYTGWGKLSAKLINGIRDKKSGKTILDYLIDDGEINRNFMQLIHDDGLSFKEIIQKAQVFGKTNDVKQVVQELPGSPAIKKGILQSIKIVDELVKVMGHAPESIVIEMARENQTTARGKKNSQQRYKRIEDSLKNLASGLDSNILKENPTDNIQLQNDRLFLYYLQNGRDMYTGKPLEINQLSNYDIDHIIPQAFIKDDSLDNRVLTSSKDNRGKSDNVPSLEVVEKMKAFWQQLLDSKLISERKFNNLTKAERERGGLNELDKVGFIKRQLVETRQITKHVAQFLDARFNKEVTEKDKKNRNVKIITLKSNLVSNFRKEFGLYKVREINDYHHAHDAYLNAVLAKAILKKYPKLEPEFVYGDYQKYDLQRYISKSREPKEVEKATQKYFFYSNLLNFFKEEVHYADGTIVKRENIEYSKDTGEIAWNKEKDFATVKKVLSLPQVNIVKKTEVQTGGFSKESILPKGNSDKLIPRKTKEILWDTTKYGGFDSPVIAYSILLIADIEKGKAKKLKTVKTLVGITIMEKATFEKNPITFLENKGYHNVRKENILCLPKYSLFELESGRRRMLASAKELQKGNEIVLPVYLTTLLYHSKNVHKLDEPEHLEYIQKHRYEFKDLLNLVSEFSQKYVLADANLEKIKNLYADNEQADIEILANSFINLLTFTALGAPAAFKFLGKDVDRKRYTTVSEILNATLIHQSITGLYETRIDLSKLGED

SEQ ID NO: 775 - protein, 206 aa, Streptococcus sp.
RTPFQALDSMDDAWSYREFKSYVKESKLLGNKKKEYLLTEEDISKIEVKQKFIERNLIDTRYSSRVVLNALQDFYKAHKFDTTISVVRGQFTSQLRRKWGLEKSRETYHHHAVDALIIAASSQLRLWKKQNNPLIAYKEGQFVDSETGEIISLSDDEYKELVFKAPYDHFVDTLSSKTFEDSILFSYQVDSKFNRKISDATIYATR

SEQ ID NO: 776 - protein, 1122 aa, Streptococcus suis
MSNGKILGLDIGIASVGVGVIDAQTGEIIHASSRIFPSANAANNAERRTFRGSRRLIRRKKHRIKRLDDLFNDFHINLDGEMSTDNPYVLRVKGLSQKLTVEELYISIKNIMKRRGISYLDDAESDNEAGRSDYAKAIERNRQLLTSKTPGEIQLERLEKYGQLRGNFTIIDEEGQSQQIINVFSTSDYVKEVEKILDCQKMYHKFISDEFCDKLIELLREKRKYYVGPGNEKSRTDYGIYRTDGTTLENLFGILIGKCTFYPDQYRSSRASYTAQEFNFLNDLNNLTVPTETKKLSQEQKEFLVNYAKETSVLGAGKILQQIAKLADCKVEDIRGYRLDNKDKPELHTFETYRAMKGLVPLVDIGVLSREQLDILADILTLNTDFEGIREALKKQLPNVFDEKQVKGLASFRKSKSQLFAKGWHNLSQKIMLEVIPELYATSDEQMTILTRLGKFEKSSVAEYPSSINVDEITDEIYNPVVAKSIRQTIKIINASIKKWDEFDQIVIEMPRDRNEDEEKKRIADGQKANAKEKADSILRAAELYCAGKVLPDYVYNGHNQLATKIRLWYQQGERCIYTGQPISIHDLIHNQNQYEIDHILPLSLTFDDSLSNKVLVLATANQEKAQRTPYNYLKSATSAWSYREFKDYVTKRKGIGKKKCEYLTFEEDINGFEVRSKFIQRNLVDTRYASKVILNALQDYFKISGIQTKVSVVRGQFTSQLRHKWGIEKTRETYHHHAVDALIIAASSQLRLWKKQESPLVVDYQEGRQVDLETGEILELTDEQYKELVYQPPYQGFVNTISSSAFDNEILFSYQVDSKVNRKISDATIYATRNAQLGKDKTEGIYVLGKIKDIYTQAGYEAFLKRYTKDKTSFLMYHKDLDTWEKVIEIILRDYREYDEKGKEIGNPFERYRRENGYVKKYSRKGNGTAIKSLKYYDNKLGNHIDITPENSRNAVVLQSLKPWRTDVYFNKETGKYEFLGIKYSDLSFEKGTGEYGISQEKYDSIKIAEGVAKKSIFKFTLYKQDLLFIKDIENNFGKLLRFTSKNDTSKHYVELKPYDKNKFGTEEPLLPVLGNVAKSGQCIKGLNKSNISIYKVRTDILGYRHFIKQEGEHPQLKFKK

SEQ ID NO: 777 - protein, 1381 aa, Streptococcus suis
MVKKKYAIGIDIGTNSVGWSIVTDDYKVPSKKMKVFGNTEKRYIKKNLLGTLLFDEGNTAENRRLKRTARRRYTRRRNRILYLQEIFAEEINKIDDSFFQRLDDSFLIVEDKQGSKHPIFGTLQEEKEYHKQFPTIYHLRKQLADSSQKADIRLIYLALAHIIKYRGHFLFEGDLKSENKDVQHLFNDFVEMFDKTVEGSYLSENLPNVADVLVEKVSKSRRLENILHYFPNEKKNGLFGNFLALALGLQPNFKTNFELAEDAKIQFSKETYEEDLEELLGKIGDDYADLFIATKSLYDGILLAGILSTTDSTTKAPLSSSMVNRYEEHQKDLALLKNFIHQNLSDSYKEVFNDKLKDGYAGYIEGKTTQENFYRFIKKAIEKIEGSNYFIDKIDREDFLRKQRTFDNGSIPHQIHLQEMHAIIRRQAEFYPFLVENQDKIEKILTFRIPYYVGPLARGKSEFAWLNRKSDEKIRPWNFDEMVDKETSAENFITRMTNYDRYLPDQKVLPKHSLLYEKFAVYNELTKVKFIAEGMRDYQFLDSGQKKDIVKTLFKTKRKVTAKDIKAYLENSNGYAGVELKGLEEQFNASLPTYHDLLKILRDKAFIDAEENQEILEDIVLTLTLFEDREMIRKRLEKYKDILTEEQRKKLERRHYTGWGRLSAKLINGILDKVTRKTILGYLIDDGTSNRNFMQLINDDTLSFVDEIRLAQGSGEAEDYRAEVQNLAGSPAIKKGILQSLKIVDELIEVMGYEPEHIVVEMARENQFTNQGRRNSQQRINRLENALKDFGSKILEEQKPYGVSKVNNIHLQSDRLFLYYLQNGKDMYTDEELDIDHLSEYDIDHIIPQAFIKDDSLDNKVLTKSAKNRGKSDDVPSMEIVHNRKNFWRQLLKSKLISQRKFDNLTKAERGGLTNEDKARFIQRQLVETRQITKHVARMLDTRFNTKLDEAGNRIRDPKVNIITLKSNLVSQFRKDYQLYKIREINNYHHAHDAYINAVVATALLKKYPQLAPEFVYGEYPTYNSYNSRKSATEKVLFYSNIMNFFKRIVVHSKTGEVRIRPVIEVNKETGEIVWDKKSDFRTVRKVLSYPQVNVVKKTEVQNHGLDRGKPKGFYNANLSPRPKEGSVENLVPAKQSFDTKRYGGYAGISNSYAVLVNGIIEKGKKKSKAEVTEFQGISILARKDFDKNPKQYLLNLGYKDIKSIIKLPKYSLFELENGSRRMLASILSTNNKRGEIHKGNEMYLPDKFVTLLYHAMRVNRTLEPGHKKYVETHRHVFDELLIYILEYNEKIVGAKANGKRIVEAYSARKDTDNLEELCNSFINLLNLTALGSAVDFEFLGTKIPRYRDYTPSSLLKATLIHQSVTGLYETRIDLSKLGGD

SEQ ID NO: 778 - protein, 39 aa, Streptococcus thermophilus
GRCIKGLGKSNISIYKVRTDVLGNQHIIKNEGDKPKLDF

SEQ ID NO: 779 - protein, 302 aa, Streptococcus thermophilus
MIRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAERFILSKPIEK

SEQ ID NO: 780 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQMNEKGKEVPCNPFLKYKEEHGYIRKYSKKGNGPEIKSLKYYDSKLGNHIDITPKDSNNKVVLQSVSPWRADIYFNNTTGKYEILGLKYADLQFEKGTGTYKISQEKYNDIKKKEGVDSDSEFKFTLYKNDLLLVKETETKEQQLFRFLSRTMPKQKHYVELKPYDKQKFEGGEALIKVLGNVANGGQCIKGLGKSNISIYKVRTDVLGNQHIIKNEGDKPKLDF

SEQ ID NO: 781 - protein, 1121 aa, Streptococcus thermophilus
MSDLVLGLDIGIGSVGVGILNKVTGEIIHKNSRIFPAAQAENNLVRRTNRQGRRLTRRKKHRIVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKEYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASIQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPVNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 782 - protein, 1121 aa, Streptococcus thermophilus
MSDLVLGLDIGIGSVGVGILNKVTGEIIHKNSRIFPAAQAENNLVRRTNRQGRRLTRRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFVNRYLEILTGKRKYYHGPGNEKSRTDYGRYRTNGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILKRLGKQKTTSSSNKTKYIDEKLLTEEIYNPVVAKSIRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNDPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 783 - protein, 1122 aa, Streptococcus thermophilus
MSDLVLGLDIGIGSVGVGILNKVTGEIIHKNSRIFPAAQAENNVERRTNRQGRRLTRRKKHRRVRLNRLFEESGLITDFTKISINLNPYQLRVRGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKASSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKLSDATIYATRQAKVGKDKKDETYVLGKIKDIYTQDGYDAFMKIYKKDKSKFLMYRHDPQTFEKVIEPILENYPNKEMNEKGKEVPCNPFLKYKEEHGYIRKYSKKGNGPEIKSLKYYDSKLLGNPIDITPENSKNKVVLQSLKPWRADVYFNKTTGKYEILGLKYADLQFEKKTGTYKISQEKYNGIMKEEGVDSDSEFKFTLYKNDLLLVKDTETKEQQLFRFLSRTMPNVKYYVELKPYSKDKFEKNESLIEILGSADKSGRCIKGLGKSNISIYKVRTDVLGNQHIIKNEGDKPKLDF

SEQ ID NO: 784 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVCEINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 785 - protein, 1388 aa, Streptococcus thermophilus
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 786 - protein, 595 aa, Streptococcus thermophilus
MVQFRKANSSIFGKGWHNFSVKLMMELIPELYETSEEQMTILKRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNPNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQFLDIETGELISDDEYKESVFKAPYQHFVDTLKSKEFEDSILFSYQVDSKFNRKISDATIYATRKAKLDKEKKEYTYTLGKIKDIYTQAGYDAFIKIYKKDKSKFLMYHHDPQTFEKVIEPILENYPNKEINEKGKEVPCNPFLKYKEEHGYIRKYSKKGNGPEIKSFKYYDNLLGRHIDITPKNSKNIVALRKLNPWRTDVYFNHETMKYEFLGLKYADISYKKSKNKAGDFLPK

SEQ ID NO: 787 - protein, 1388 aa, Streptococcus thermophilus]
MTKPYSIGLDIGTNSVGWAVITDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKVYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKNLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDFPSLEVVKKRKTFWYQLLKSKLISQRKFDNLTKAERGGLLPEDKAGFIQRQLVETRQITKHVARLLDEKFNNKKDENNRAVRTVKIITLKSTLVSQFRKDFELYKVREINDFHHAHDAYLNAVIASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFAVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 788 - protein, 1038 aa, Streptococcus vestibularis
MIDELSNEELFIALKNMVKHRGISYLDDASDDGNSSVGDYAQIVKENSKQLETKTPGQIQLERYQKYGQLRGDFTVEEDGKKHRLINVFPTSAYRAEALRILQTQQEFNSQITDEFINRYLEILTGKRKYYHGPGNEKSRTDYGRYRTSGETLDNIFGILIGKCTFYPEEFRAAKASYTAQEFNLLNDLNNLTVPTETKKLSEEQKNQIINYVKNEKAMGPAKLFKYIAKLLSCDIADIKGYRIDKSDKAEIHTFEAYRKMKTLETIDIEKMSREELDKLAYVLTLNTEREGIQEALEHEFVDGNFSQEQIDELVQFRKANSSIFGKGWHNFSVKLMMELIPELYATSEEQMTILTRLGKQKTTSSSNKTKYIDEKLLTEEIYNPVVAKSVRQAIKIVNAAIKEYGDFDNIVIEMARATNEDDEKKAIQKIQKANKDEKDAAMLKAANQYNGKAELPHSVFHGHKQLATKIRLWHQQGERCLYTGKTISIHDLINNPNQFEIDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVNYSENQLLDIETGELISDDEYKESVFKAPYQHFVDTLKSKEFEDSILFSYQVDSKFNRKISDATIYATRKAKLDKEKKEYTYTLGKIKDIYALGTKTPSKTGFYKFLDLYKKNKSQFLMYQKDRKTWDEVIEKILEQYRPFKEKDKNGKEVDFNPFEKYRIENGPIRKYSRKGNGPEIKSLKYYDNLLGRFVDITPSESKNPVALLSLNPWRTDVYYNTETRKYEFLGLKYADLCFEKGGSYGISKVKYNKIREKEGIGKNSEFKFTLYKNDLILIKDTETNRQQVFRFWSRTGKDNPKRFEKHKIELKPYEKARFEKGEELEVLGKVPPSSNQLQKNMQIENLSIFKVRTDVLGNQHIIKNEGDKPKLDF

SEQ ID NO: 789 - protein, 97 aa, Streptococcus vestibularis
MSDLVLGLDIGIGSVGVGILNKVTGEIIHKNSRIFPAAQAENNVERRTNRQGRRLTRRKKHRRVRLNHLFEESGLITDFTKVSINLNPYQLRVKIDR

SEQ ID NO: 790 - protein, 1084 aa, Subdoligranulum sp.
MKNTLYGIGLDIGVASVGWAVVGLNGTGEPVGLHRLGVRIFDKAEQPKTGESLAAPRRMARGMRRRLRRKALRRADVYALLERSGLSTREELAQMFEAGGLEDIYALRTRALDEPVGKAEFSRILLHLAQRRGFKSNRRTASDGEDGRLLAAVNENRRRMAQGGWRTVGEMLYRHEAFALHKRNKADDYLSTVGRDMVAEEASILFERQRAMGCSWAAPELQAEYLSILLRQRSFDEGPGGNSPYGGNQVEKMVGRCTFEPDEPRAAKAAYSFEYFSLLQKLNHIRLAENGETRPLTQPQRQQLLSLAHKTPDISLARIRKELALPETVQFNGVRCRANETLEESEKKEKFACLPAYHKMRKALDGVVKGRISSLSISQRDAAATALSLYKNEDTLRAKLTEAGFQAPEIDALAGLTGFSKFGHLSLKACRKLIPHLEQGLTYDQACTAAGYDFKGHGAGERAFTLPAAAPEMEQITSPVVRRAVAQTIKVVNGIIREMDASPAWVRIELARELSKTFGERQEMDRSMRENAAQNERLMQELRDTFHLLSPTGQDLVKYRLWKEQDGVCAYSLRRLDVERLFEPGYVDVDHIVPYSLSFDDRRSNKVLVLSSENRQKGNRLPLQYLQGKRREDFIVWTNSSVHDYRKRQNLLREKLSGDEAEGFRQRNLQDTQHMARFLYNYISDHLAFAQSEALGKKRVFAVSGAVTSHLRKRWGLSKVRADGDLHHALDAAVVACTTDGMIRRISGYYGHIEGEYLQDADGAGSQHARTKERFPAPWPRFRDELIVRLSEQPAEPLLDINPEFYCEYGTEHIRPVFVSRMPRRKVTGPGHKETIKGAAAADEGLLTVRKALTELKLDKDGEIKDYYMPSSDTLLYEALKAQLRRFGGDGKKAFAEPFYKPKADGTPGPLVRKVKTTEKATLTVPVHGGAASNDTMVRVDVFLVPGDGYYWVPVYTADTLKPELPNRAVVQGKPYSEWKEMREEDFIFSLYPNDLVYVEHKSGLKFTLQNADSTLEKTRTQTSAFAYFVSGSISTASITIRTHDNAYGIPSLGVKTLKTFHKYQVDVLGNVFPVHKETRQKFR

SEQ ID NO: 791 - protein, 951 aa, Sutterella parvirubra
MPTVRPVFHSSASFDLGAKNTGLFLVNHPAGAAPSAEYAAAYTIVQPADGDGLNYSTTNRRAVRHRLRGGKRFKLARRLVLQVIDALRKLKPGLIRDEEMRRTVEALSSLLKRRGFTRIESEAQVDPTTLDSVDPAVFADHETLGGFFSLGIPISTQWDALSQNPGAVEQLFKALPSAKDFGKYVTEQFPEFAEQKKLYADAIKVLSSEAKSIVMQLGLGHHHRSKYFEMIAHDMLRDPRLQGVFELFGSEERFKTFICNVSNLQLRALRWYFDEPNPEVANQWNPEKFQVVWLRGLKYFHPDAERKADMKKLIDELTASKDILDALCTTDPRRTIPPYEDQNNRRPPFDQTLWLSAAELTRRYGDKWRIWSQKFERADRALSTGLDEILLYTDRRSRMFNRNQDPSVYADSYVLQRVLDRSSKLDRYALRALAAGYRTQELHEPLATLSDTLGTQHVETFLTFAAEYYEEVAAAKNGLWLDGPSRLLERADIHPPMKKKVLDLLLGNILDATPEIGRILRTVLWNRHVHEKSRSTPASLCRSIEAIRKDFGGEFRMRYDALDAKIRAAEDQKKKFKPTNAEEKDLFKAWNATKTMHAFLRDVLQLTPKQLERTASPYVFAQLHTLIDTERDGFTSTSLAAHLENHWRMRANAAGMAQCSRLPADAVRPFDGVLSKALDRQAFEAAKLAAQHLMSRKELTDTDIRYSIIIESNRFAFSASTAELKKNTLAKKNAEKGLNFELKRWQDKDSRIREASRGICAYTGAKLGDVVEYDHIIPRAFTTSAMGSVFNSEANLICVSRPGNQTKADKRYGLNKLHKTYLTAVFGTADVTTIAASIEDIVGKLASANRLRHFELLNEKEQDAVRHALFLDDESDARRIVLRELAAQNKSRVNGTQAWFVRAFMTKLLEITKDWRERTGNTLDIRSWKTDAEVASRLRSALNFHAEITLT

SEQ ID NO: 792 - protein, 406 aa, Sutterella parvirubra
SNLFREEVPYGDHFLPIIQMKNRIYIGYQLPKADGTGGNAVAVLGKDPLELLETLKPFLDREPQAFSDHPVTYKMINERAYELLTKCALTPDQTTELERTQAEVLRSLNYQTSRAAVLGRLVDDKNKFVAKDAVWKEKDFVISFKLSPKKSAFKASGQLELPAKSDWKALVDSPELAINWGQPADDTFSQRIERKVRMNSSHLEHTPKKRVVSLPVVDKPSGGFRIRRHNLDGSAVFQVHTVANNKYGGFSADSAGKVDWSTPVLCGHLQHANLVPLDPETASAEQLVRMSEWRVVETTSDIRLEVCPGTSGRRYVRVELPFTLLQEWLTAGKVADVPVSPLHLPGSIKLTDPKTFCAEAQKTLSIFAQPRATIFFEQLGDRVRFRFEASGGPATMNAAYNAAGRS

SEQ ID NO: 793 - protein, 389 aa, Sutterella wadsworthensis
MKACDLEEKTNHLQACVAIDLGARYTGTFSILHKSSHLPSKDDCRAATYVLPEDGGKMTYSQRNRTAVRHRIRGKKRFALARRMAMLIIREKLAAKSVTLTSSETRRLAEAVGSLLRRRGYNRLETETDNDLTVLENIEPEVFSEHEILGKYFYAGTDLAIQWETLSQDLSKISSLLAERLSEKDFKKYLTGLIPDDKNKIKHIISVFKMLIDEAESINMQCVLGHKHRTQYLSDIHADMHRDTRLSKAAEAFGGVDRLWRLLGNLSNLQLRAHRWYFNAPHLFDDQALEPARLQKTLVRAFKYLHCPQGVESRAQAELVKELEEADDIIDALCTIDPVRTIPPYENQQNRRPPFDQTLYLSPDLGVSGFLCLGRLFQGQPNEAALCFL

SEQ ID NO: 794 - protein, 976 aa, Tannerella sp.
MKKILGLDLGSNSIGWALVNEAENRDEASSIIKLGVRVNPLTVDEMQNFEKGKSITTNADRTLKRSMRRNLQRYKLRRDALIKLLKKVGFITDGTILSEQGNRTTFETYRLRAKAPDEEISLQELARVLLMINKKRGYKSSRKIKEKEAGTLIDGMEVAKKLYDEDLTPGQLCLQLLESGKKSLPDFYSSDLQEEFDRIWNFQKQFNPKAFCDTAKEEIKGKNKSQTWAILAKYFIWMEEMDVWNEKESKTERVEKECKLVGLKRTVKKEEQRKENYCWRVQALTEQLDLEKVAVVLQEINGQISTSSGYLGAISDRSKVLYFNRQTVGQYQMAELEKNPNTSLRNMVFYRQDYLDEFDKIWEKQAEFHKELTVELKKEIRDIIIFYQRRLKSQKGLIGFCEFENREIMVEKNGKMQAKVVGCKVIPRSHPLFQEFKIWQTLNNVEVFAGEKKCKRKRTDAFPGLFDGTEDTLMVEGWRYLYQEEKEILAKELSVKKSLKKEYILKLLFDNPQDLDMNFEQIEGNDTGNVLFSAYSKMIEKYGYEPLDFGKPTDKIIEQLQVIFADLGWNTDLLFVDLNKEGKDLEKQPYFKLWHLLYSFEGDNTPTGNGKLVEKLMELCHVGKECALELVNISFQNDYGSLSAKAIKKILPYLKEGNRYDVACGYAGYRHSKSSLTKEEIENKVLKDKLDILPKNSLRNPVVEKILNQMVNVINAIIDTYGKPDEIRVELARELKKSAKEREELTKAIAKSTREHEEIRKVLQEEFGMINVSRNDIIRYKLYKELKDNGYKTLYSNQDIPKEKVFSKEIDIEHIIPQARLFDDSLSNKTLEYKAINIEKGNKTAYDFVKEKYGEKGLQQYLNRCESLFKGHRTKLRKLKMGQENIPEGFIDRDLRNTQYIAKKALAMLNEICRRVVATTGSITDRLREDWQLVDVLKELRCFRYFKDTKMKANHNKNIFYTSIKVDVSDTSKILK

SEQ ID NO: 795 - protein, 1049 aa, Tistrella mobilis
MINERLTFGIDLGIGSCGWAVLRHADAAGEPGVIEGLGSWCFDVPETSKERIPTNQVRRSNRLLRRVIRRRRNRMAEIRRLFHAQGLLPSADEDALKRPRLDPWELRARGLDQCLSAEEFAVALGHIARHRGFRSSAKRKAANTSGEDSKMLSALLVTRERTARYRTVGEMFARDPEYSARRRNRDGIFDRTVARDDLIHEVGKLFEAQRARGSAFASPDLEADFNAIAFRQAEMQDSERLVGNCPFERDEKRAARWAPSFERFRLLTRLINLRIATAEGERRFTPEDLARVSAELGATAKLPVSRVRALIGLLPDERFTTIRVEDEDRDIVARTGEAAPGTWRLRKTLGEALWAEMQARPDQLDAIAHVLSFFEATAKIRSELDRLGLPAAVIEALDRGLEDGAFAKFKGAGHISAKACRNLLPHLQQGHRYDQACRLAGYDHAASTLSHTAQVVSKAGFNALVTELGESIANPIARKALTEGLKQIRAMCARWGLPGAIHIELAREVGNSIEKRRELESQRETTTKRRQTERDEIRGLLALEDVDDDTLLRYRLWKEQGGKCLYTGKDIHVRQLIATDNSVQVDHILPWSRFGDDSFNNKTLCLASANQRKRGQTPWEWFSLTGTPEAWEVFASRVETSKDLRGFKKRNLLLKNADEVAQRFRSRNLNDTRYAARLLAEAAKLFYPAGDRQEKDGRRRVLTRPGPLTAALRHAWGLESLKKADGKRVSDDRHHALDALAVAAISEREVQRLTRSFQEWEQQGLARPLRHVAPPWPGFRGDVLAAYAQAFVARPERRRARGKGHDASIRQVVGEGPEAQVFERRGLADLKEADLDRVKDPERNQAIIEAVRAWILAGRPADAPPRSPRGDVIVKLRTAPAKKIKPAVPVRGGTADRGDMVRIDVFTRPNRKGRDEWYLVPIYPHQVMNRKAWPHPPMRSVVAYKDEAGWTEIGAEHSFRFSLYPRSYVQLVKSNGDVIEGYLVSMDRSTGAFRVFVHNNPAEMAKGIGAKTLLNLRKFNVDRFGVRTEVKSEVRTWHGEVCTSPVPPD

SEQ ID NO: 796 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSELQHIGGSKYSGVAKIGNKISSLDNCILIYQSITGIFEKRIDLLKV

SEQ ID NO: 797 - protein, 769 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKCCGRL

SEQ ID NO: 798 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENALFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKAVIKKHFPNNYKKVFGYNQDNESKNNYSGYVGVCKTKNKKLVINNSVNQEDFYKFLKPILSAKSEIKEVNDILAEIETGNFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYDGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 799 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPFYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGAFSNISKYGGYNKVSAAYYTLIEYEEKGNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNPDNCILIYQSITGIFEKRIDLLKV

SEQ ID NO: 800 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMELDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSAYVGVCKITHKKLVIKNSASQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDAEKQFSYNGLVKPLFLSPSVKKMLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 801 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKIDEGFFQRMKESPLYAEDKTILQENTLFNDKDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLIGESVLPKNSLLYSEYTVLNEINNLQIIIDGKNICDTKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKFNRLTRATPISDDETAKFIARQLVETRQATKVAARVLEKMFPETKIVYSKAETVSMFRNKFDIVKCREINDFHHAHDAYLNIVVGNVYNTKFTNNLWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNDEVLYFKKIIRFSEIRSQREKIGKTISPYEDLSFRSYIKENLCKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 802 - protein, 357 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQAFFEYLREDMEVDIDADSQKIKEILKDSSLKNSEKQSRLNKILGLKSSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKITTITPDM

SEQ ID NO: 803 - protein, 1395 aa, Treponema denticola
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENALFNDRDFTDKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKMLGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPNDYKKVFGYNKNEKNNNNYSAYVGVCKTKSKKLVINNTVNQEDFYKFLKPILLAKSEIKEVNDILTEIETGTFLPKQISKSNAEIPYQLRKMELEKILSNAEKHFSFLKQKDEKGLSHSEKIIMLLTFKIPYYIGPINDNHKKSFPDRCWVIKKEKSPSGKTTPWNFFDHIDKDKTAEAFITSRTNFCTYLVGESVLPKNSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDSLVKPLFLSPSVKKMLWQTLKLVKEISHITQAPPKKIFIEMAKGAELDPVRTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKAEIQSKQRGFWNFLQRNNFISLEKLNRLTRTSPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPLSNISKYGGYNKVSAAYYTLIEYEEKGSKIRSLETIPLYLVKDIQKNKDGLKSYLTDQIGKKEIKILIPKIKINSLLKINGFPCHITGKMGEAFVLRPAVQFCCSNDEALYFKKIIRFNEIRKQREKMGKTISPYEDLSFRSYIKDNLCKKTKADEIEEKEFYDLLQKKNLEIYDMLLTKHKDTIYKKRPNSATIDILVKGKEKFKSLIIENQFEVILEILKLFSATRNVSDLQHIGGSKNAGNARVGNKISSLDNCILIYQSITGIFEKRIDLLKI

SEQ ID NO: 804 - protein, 631 aa, Treponema denticola
MLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLRSEIQSKQRGFWNFLQRNNFISLEKLNRLTRTTPISDDETAKFIARQLVETRQATKVAAKVLEKMFPETKIVYSKAETVSMFRNKFDIVKCREINDFHHAHDAYLNIVVGNIYNTKFTNNPWNFIKEKRDNPKIADTYNYYKVFDYDVKRNNITAWEKGKTIITVKDMLKRNTPIYTRQAACKKGGLFDQTIMKKGLGQHPLKKEGPFSNISKYGGYNKVSAAYYTLIEYEEKENKIRSLETIPLYLVKDIQKSQEKLKSYLTDLLGKKEIKILVPKIKINSLLKINGFPCHITGKTNDSFLLRPAVQFCCSNDEVLYFKKIIRFNEIRSQREKMGKTISPYEDLSFRSYIKENLCKKTKNDEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 805 - protein, 631 aa, Treponema denticola
MLWQTLKLVKEISHITQAPPKKIFIEMAKGAELEPARTKTRLKILQDLYSSCKNDADAFSSEIQYLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRTTPISDDETAKFIARQLVETRQATKVAAKVLEKMFPETKIVYSKAETVSMFRNKFDIIKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKVNKIRSLETIPLYLVKDIQKDQDVLKSYLTDLLGKKEIKILVPKIKINSLLKINGFPCHITGKTGDSFVLRPAVQFCCSNDEVLYFKKIIRFNEIRSQREKMGKTISPYEDLSFRSYIKENLCKKTKADEIGEKEFYDLLQKKNLEIYDMLLTKHKDTIYNKRPNSTTLGMLTKGRYEFINLKPKDQIIVMLEILKLFCTTREAIDLGLIKGKPAAGVATLGKKISNLDNCILIYQSITGIFEKRIDLLKV

SEQ ID NO: 806 - protein, 370 aa, Treponema denticola
MTEIETGTFLPKQISKSNAEIPYQLRKMELEKILSNAEKHFSFLKQKDEKGLSHSEKIIMLLTFKIPYYIGPINDNHKKSFPDRCWVVKKEKSPSGKTTPWNFFDHIDKEKTAEEFITSRTNFCTYLVGESVLPKSSLLYSEYTVLNEINNLQIIIDGKNICDIKLKQKIYEELFKKYKKITQKQISTFIKHEGICNKTDEVIILGIDKECTSSLKSYIELKNIFGKQVDEISTKNMLEDIIRWAAIYDEGEGKTILKTKIKAEYGKYCSDEQIKKILNLKFSGWGRLSRKFLETVTSEMPGFSEPVNIITAMRETQNNLMELLSSEFKFTENIKKINSGFEDVEKQFSYDGLVKPLFLSPSVKKCCGRL

SEQ ID NO: 807 - protein, 591 aa, Treponema phagedenis
MARGKEAEKGRTSSRYASIKALYENCKQDLADYDAVLEQFKSEEPLRLRSDKLYLYYTQLGRCMYTGRVIDIDRLMSDNSAYDIDHIYPRSKIKDDSLTNRVLVVKDANQDKRDEPLSPQIQDKQKGFWDFLKHNNFISIEKYERLTYRGYFTEEMLSGFIARQLVETRQGTKTAGQILEQLYPDSTVVYCKAANTSEFRQKFNLIKCREINDLHHAHDAYLNIAVGNVYYTKFTSNPRNFMKLKEPYNLRELFDRDVERNNTIAWVKNKTITTIKDMLKRNTPLYTRYAYCKTGGFFDQNIMKKGKGQFPLKENSPLSDISKYGGYNKVSGAYFILVQKKEKDAVVRILETVPLYLLNKPGKESENVREYLSTALGTKDFKILIPKIKINSLFKINGFLVHITGKTNDRFLVRSAVQFFCDDNLTLFFKRIIAFNGLRNLNKDKSMTAYDDNTMRVYVRGNLFKDKNQLFDKNKFNEIVKGKNISVYKDMVKRYETSIYKFRPNTAVIPILKSGEDKFINLPIEEQFKILQEILKLFGAINGTANLTLIGGRPSTGEMKISNNISNLKQCILIHQSPTGVFEQQIDLLKI

SEQ ID NO: 808 - protein, 1062 aa, Treponema sp.
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEKIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 809 - protein, 281 aa, Treponema vincentii
MKTLGLDIGTNSIGWGIVDETANKIEDCGVYIFPEGVKKEKGNESSKAAERTSFRLARRLKFRRKLRKCETLKVLIKNKMCPLTMEELEKWRKQKIYPVSQDFLNWYRTDELKNWEPYFLRKKCAEQKAGPYEIGRALYHLAQRRGFLSNRKESTKASDGKVSKSIDELSSLMDGRTLGQYFYELKQSGEKVRGKYTSRKEHYEKEFNKICEVQEISPELKDDLYRAIFFQRKLKSQKFLVGKCTFERNKPRAPISHFEFEEFRMLSFINSIKIAKKLRRR

SEQ ID NO: 810 - protein, 675 aa, uncultured bacterium
MTAENYSNVRFAFDIGTNSIGWAVFQLNDKQEATSILNAGARIFSDGRDPKTFEPLAVRRRNVRSASRMRDRYLRRRKRTLDKLIGYGLLPEDKAERDKILLETNDKPSGSTDKKTDPYSLRARALEEKLPLAYVARALFHIGQRRGFKSNRKADRKSNEKGKIAAGIEELSGLMHQSHAPTLGAYLAKRREEGHVVRLRASSEALTNKAYAFYPERAMLEDEFHKIWQAQAEYYPDVLTKEREEELFHVMFFQRPLKEQKVGLCTLVEGELRLPKSDPLFQQFRLYKEINELAIILPDLSQRKLTMEERDTLITLMRPAKTKTFAALRKALKIPAGGRFNKETENRKQLTGDEVYSVFSKPELFGGDWAKFSIEQQREIIDQLNNEENPDKLEEWLKNKFPKLSDEQRSEIINANLPDGYGRFGITATSKILEQLKKDVISEAEAAHRCGFDHSLANRNWKGLDELPRYQEVLERHIVPGTGDKNDIYDIYKGRLTNPTVHIGLNQVRRLTNRLIKAYGKPWQIVVELARDLPMSSEERKEHNKTLNDNIKAGFERTQKLERLGQKDNANNRLLLKLWEELGKDPDDRKSIYSGTRITEPMLFSGEVEIDHILPFSLTYDDSYANKILCLREENRIKRNRAPADVTEWKDRYDEIIGRSKNCQRTNKNVLGPMQ

SEQ ID NO: 811 - protein, 1017 aa, uncultured bacterium]
MRVDSLGRCLSDEEWARVIYHLCKHRGFHWISRAEAKQTEGDSKSEGGKVKQGLAGTAKLMDEKGYRSAAEMVLAEFPEAQRNKQGEYRKALSRELLAKELALLFARQRVFGNRHATDTLETAILGNSDKKSGLFWQQKPALAGADLLKMLGTCTFEKNEYRAPKASFTAERHVWLTRLNNLRIVTDGITRQLTEQERQLVLPLPYRQAGDLTYKQLGMALTKAGLLEAGCFKFIGLAYPTEAQKAEGKTKDPESATLVKIPAWQELRQTLNKASLNDEWEKLSGDALCGQPEIFDKIAWILSVYKDDDEVRTELAKLVLPNPEGLTEALLNIRFDKFHALSLKALRAIVPHMEKGLRYDEACVQAGYHHSQLHKIGEGEHKYLPPLYDGRDGDGRMIFAEDADIPRNPVVLRSLNQARKVVNAIIRRYGSPSAVHIEMARDLSRPFDERNKIKKDQDEYQARNQRDREQFIELFGHPPKGLEFEKWRLYREQNGQCAYSQKPLASSGDVAEIFLDGSTEIDHALPYSRSFDDSKNNKVLVLTRENRDKGNRTPYEYLGGAENSERWQRFFSFVESNKAYRLAKRTRLLRKDFGAKESEEFRERNLNDTRYVCRFFKNYVEQHLKLAEGSEAKRCVVVSGQLTNFLRTRWGLLKIRSDSDRHHALDAAVVAACSHSMVQRLSNYSRTRELEQVRDGFVNIETGEIVNPAMHQQLREHFPDPWPYFRHELEARLKIDSPALLREEMARLSSYTEEELAALKPLFVSRAPQRRNGGAAHKDTIYGQPEKLKKNGSVSQKVALASLALKDIDLLADPHRNAKLYGAIRERLEAHGGKGDKAFPATNPLRKPDKEGNPTGPIVRTVTKVIDKLSGIPVRGGIAKNDTMLRVDVFTKAGRFHLVPVYVHHRVTGLPNQAITRGKDENQWAIIDDTFEWRFSLYPNDLVQIRLKDETHLGYYASTDRSTSSISIWAHDRNQSVGKDGLIRSIGVTTAKDIEKFHVDTLGNVYPAPPEKRRGLA

SEQ ID NO: 812 - protein, 600 aa, uncultured bacterium]
VNAIIKKHGSLSAVHIEMARDLSRPLDERREVKKLQEEFKDRNDKARESFEADHGYRPKGIVFEKWMLYREQHGKCAYSMEGLDIDRVLNDANYAQIDHALPYSRSYDDSKNNKVLVLTRENQNKGNRTAYEYLTSFAGGEDGDRWRNYAAWVNSNKSYRMAKRNRLLRKNYGPDEASGFKDRNLNDTRYICKFFKNYVEEHLQLAPRADGNANKRCVVVNGQLTAFLRARWGLSKVRSESDRHHALDAAVVAACSHGMVKALADYARNKEVAYLREGFPDPETGEIINPEAHARGVHHFPEPWAHFRHELQVRLYSDDLQALREDLQRLGTYSEQDLLGVRTLFVSRAPQRRNDGAVHKETIYAQPEALRKQGGVVQKVPLTSLSLKDLDNLADPHRNAKLYTALRARLEAHGGKADKAFGPDQPFYKPDKNGNPTGPIVRTIKLVIDKLSGIPIRGGVAKNDTMLRVDVFTKAGKFHLVPVYVHHRVTGLPDRAIVAFKDEVEWTQVDDSFKFLFSIHPNDLIRIGLKAKEPMIGYFASCHRGTGAFNVWSHDRNTSVGKSGSVEGIGIKTALSLEKLNIDVLGNVYPARPEQRHGLA

SEQ ID NO: 813 - protein, 1011 aa, uncultured delta
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 814 - protein, 1011 aa, uncultured delta proteobacterium HF0070_07E19; identical to SEQ ID NO: 813

SEQ ID NO: 815 - protein, 1120 aa, Veillonella sp.
MGFKANLVNLFTDEDIEVILPEEKEFKSINLHEGIYEDVRDAYEDAWGDRFAIVDQCKVLHDIIVISSIIKPGQSLSEAKIESYNQHKEDLVLLKSVLKEDRKLYDDMFVVDTDKGTNYVKYTKQGVNGNTSATQEEFYKYVRKVVSVLPETEHTRRIVQKLEEGTFLPLQRISKNGVVPYQLHKEELVRILDKATVNFPFLNKVENGLTVADKIISILEFKIPYYVGPLNPTHSIENGGFAWVVRKEAGQVLPWNFEQKVDVQASAVKFIENLTNKCTYLIDQDVLPKYSLLYAEFSLLNELNNIRVNDKPLPADVKQAFIRDHFISLQDSKTATKKVVAKYLVDNNYVSQPPIITGMDQQIATKLTSHRDMTRILGEHFDHAMAEDIIRYITIFGESKDMLRQVLKNYYGDRLTTEQIKKLGKLTYTGWGRLSKKFLSDIWGMKKNDDDAEAGTIIEHMREGQENLMQLLSSSYSFIDVVQEYVTNVLGEKEKTAFEMLEDLSLSPMVKRSVWQTLRILDEIVSIRKELPKKIFVEVARTNKADKKRTQSRKALLEELYKQIKDEDVHVLQQELESKEDSALNSKKLYLYFTQMGRCMYSGRRIDIHELFTDKYDIDHIYPRSLTKDDSWHNIVLVEKQLNAEKTDRFPILSAIQSKQKGFWKLLWDRGFISEKKYDRLVRTTDLTDEELNQFINRQMVSTNQSVKAVTTLLHQLYPETEVVFSKAENVSDFRHDYDFVKVRSINHHHHAKDAYLNIVVGNVYHEKFTKNFLSFAKQKGTRRTYNLTKIFEYEIKLTEESKKVIWDPNIHMDIVKKMMKSNDVRVTQRAVPQKGGLSDETIYKKGIAKRGVYLPLKSSDERVRDVEKYGGRTSITISEYIILNIRDTSDQDRIEIFSLPLYIAGKKDIHKAIEEAYLSTCKKPASVVDIQILYRGLYIGSKVNINGFTYYMGGKTGSNVSIDSAVDVVMDITSSVYIKLLEKVAIKKIENPKTFRIENIKTSYNHKEVTVSKEQNIALYQELLKKLDTPLFSKMKGNKLEEFRTVGFDTFIALSLEEQASVLLEVLNVLTNFKTKRDITKIGMTSSRSTLGINISNTEQFSVITTSITGLYEQEIKIK

SEQ ID NO: 816 - protein, 983 aa, Verminephrobacter aporrectodeae
MRRRRDRLLKRKARMHDQLMRHGFFPADAAGRKVLERLNPYQLRAKGLHQALTPGEFARALFHINQRRGFQSNRKTDRKDNESGALKQAISELRAQIHDSGCATVGEWFWKERMQQKPEGVHRQGVRARYRETPYTTDEGRQRIDKRYDLYVDRAMIEQEFDALWAVQAALQPGLFTDAACKELRYTLLFQRKLRPVKPGRCTLLPEEERAPLALPSTQRFRILQEVNHLRLLDEALREVPLTLAQRDALVAALESQGKLGFAPMRKLLKLPGTVKFNLEDEKRTELKGNATSAILARKDLFGPAWAGFDAALQDEIVWQLVSEEGEGRLIAWLQQHTGVDEARAEAIADTSLPEGYGSLSRKALERIVPALQREVCSYDKAVQAAGFAHHSDLGFDFEHSGDEVQQVGERIIASTGEVRPLFAFKQLPYYGKALQRHVAFGSGKPEDPEEKRHGKIANPTVHIGLNQVRTVVNALIRRYGRPSEVVVELARDLKQSREQQQETQRKQAENQRRNTRIRERIAETLGISPERVRSSDIQKWILWEELSFDVVDRRCPYSGEQISTTMLLSPKVEIEHILPFSQTLDDSLNNRTVALREANRIKRNRTPWDARADFEARGWSYEGILHRAERMPLRKRYRFAPDGYQRWLGEDKDFLARALNDTRYLSRVAANYLRLVCPKPQGVRVIPGRMTAMLRAKFGLNDVLGLDGEKNRNDHRHHAVDACVIGVTDQGLMQRFARASAQAREDGLTRLVQDMPLPWPSYRDHVERAVRHIWVSHKPDHGFEGAMMEETAYGIRKDGSIKPRRKADGSAGREVVNLIRITESRQPVRHGVDSQGQPLPYKGYVGGSNYCIEITANDQGKWEGAVISTFEAYRIVRASGWGRLRHCSHGQNGRPLMMRLMIGDAVRLALDGSEKTMRVVKISANGQVFLVAPNEANVDARNRDKADPFAYVSKKAGSFQSAKARQVSISPIGELRDPGFKG

SEQ ID NO: 817 - protein, 5 aa, Artificial Sequence
  synthetic sequence
GSGGS

SEQ ID NO: 818 - protein, 6 aa, Artificial Sequence
  synthetic sequence
GGSGGS

SEQ ID NO: 819 - protein, 4 aa, Artificial Sequence
  synthetic sequence
GGGS

SEQ ID NO: 820 - protein, 4 aa, Artificial Sequence
  synthetic sequence
GGSG

SEQ ID NO: 821 - protein, 5 aa, Artificial Sequence
  synthetic sequence
GGSGG

SEQ ID NO: 822 - protein, 5 aa, Artificial Sequence
  synthetic sequence
GSGSG

SEQ ID NO: 823 - protein, 5 aa, Artificial Sequence
  synthetic sequence
GSGGG

SEQ ID NO: 824 - protein, 5 aa, Artificial Sequence
  synthetic sequence
GGGSG

SEQ ID NO: 825 - protein, 5 aa, Artificial Sequence
  synthetic sequence
GSSSG

SEQ ID NO: 826 - protein, 16 aa, Artificial Sequence
  synthetic sequence
RQIKIWFQNRRMKWKK

SEQ ID NO: 827 - RNA, 86 nt, Artificial Sequence
  synthetic sequence
ggaaccauucaaaacagcauagcaaguuaaaauaaggcuaguccguuaucaacuugaaaaaguggcaccgagucggugcuuuuuuu

SEQ ID NO: 828 - RNA, 67 nt, Artificial Sequence
  synthetic sequence
uagcaaguuaaaauaaggcuaguccguuaucaacuugaaaaaguggcaccgagucggugcuuuuuuu

SEQ ID NO: 829 - RNA, 88 nt, Streptococcus pyogenes
guuggaaccauucaaaacagcauagcaaguuaaaauaaggcuaguccguuaucaacuugaaaaaguggcaccgagucggugcuuuuuu

SEQ ID NO: 830 - RNA, 93 nt, Listeria innocua
auauuguuaguauucaaaauaacauagcaaguuaaaauaaggcuuuguccguuaucaacuuuuaauuaaguagcgcuguuucggcgcuuuuuu

SEQ ID NO: 831 - RNA, 104 nt, Streptococcus mutans
uguuggaaucauucgaaacaacacagcaaguuaaaauaaggcagugauuuuuaauccaguccguacacaacuugaaaaagugcgcaccgauucggugcuuuuuu

SEQ ID NO: 832 - RNA, 95 nt, Streptococcus thermophilus
uugugguuugaaaccauucgaaacaacacagcgaguuaaaauaaggcuuaguccguacucaacuugaaaagguggcaccgauucgguguuuuuuu

SEQ ID NO: 833 - RNA, 118 nt, Streptococcus thermophilus
uaauaauaguguaagggacgccuuacacaguuacuuaaaucuugcagaagcuacaaagauaaggcuucaugccgaaaucaacacccugucauuuuauggcaggguguuuucguuauuu

SEQ ID NO: 834 - RNA, 112 nt, Neisseria meningitidis
cauauugucgcacugcgaaaugagaaccguugcuacaauaaggccgucugaaaagaugugccgcaacgcucugccccuuaaagcuucugcuuuaaggggcaucguuuauuuc

SEQ ID NO: 835 - RNA, 110 nt, Pasteurella multocida
gcauauuguugcacugcgaaaugagagacguugcuacaauaaggcuucugaaaagaaugaccguaacgcucugccccuugugauucuuaauugcaaggggcaucguuuuu

SEQ ID NO: 836 - RNA, 115 nt, Mycoplasma mobile
uauuauguauuucgaaauacagauguacaguuaagaauacauaagaaugauacaucacuaaaaaaaggcuuuaugccguaacuacuacuuauuuucaaaauaaguaguuuuuuuu

SEQ ID NO: 837 - RNA, 26 nt, Artificial Sequence
  synthetic sequence
uagcaaguuaaaauaaggcuaguccg

SEQ ID NO: 838 - RNA, 36 nt, Streptococcus pyogenes
uuguuggaaccauucaaaacagcauagcaaguuaaa

SEQ ID NO: 839 - RNA, 36 nt, Streptococcus mutans
guguuggaaucauucgaaacaacacagcaaguuaaa

SEQ ID NO: 840 - RNA, 36 nt, Streptococcus thermophilus
gguuugaaaccauucgaaacaacacagcgaguuaaa

SEQ ID NO: 841 - RNA, 36 nt, Streptococcus thermophilus
cuuacacaguuacuuaaaucuugcagaagcuacaaa

SEQ ID NO: 842 - RNA, 36 nt, Listeria innocua
auauuguuaguauucaaaauaacauagcaaguuaaa

SEQ ID NO: 843 - RNA, 34 nt, Listeria innocua
auuguuaguauucaaaauaacauagcaaguuaaa

SEQ ID NO: 844 - RNA, 36 nt, Treponema denticola
auuuaagauccaucuuaaauuacacaacgaguucaa

SEQ ID NO: 845 - RNA, 36 nt, Neisseria meningitidis
auugucgcacugcgaaaugagaaccguugcuacaau

SEQ ID NO: 846 - RNA, 38 nt, Neisseria meningitidis
auauugucgcacugcgaaaugagaaccguugcuacaau

SEQ ID NO: 847 - RNA, 36 nt, Streptococcus gordonii; identical to SEQ ID NO: 841

SEQ ID NO: 848 - RNA, 36 nt, Bifidobacterium bifidum
augaucaaggucauugaccugacaggcauaaauuga

SEQ ID NO: 849 - RNA, 36 nt, Lactobacillus salivarius
gguuuugaccucauugauuuaacauucugaguugaa

SEQ ID NO: 850 - RNA, 37 nt, Francisella tularensis
guuucaguuguuagauuauuugguauguacuuguguu

SEQ ID NO: 851 - RNA, 37 nt, Francisella tularensis
auuacagagcauuaauuauuugguacauuuauaauuu

SEQ ID NO: 852 - RNA, 37 nt, Legionella pneumophila
auuucaggguaucgaaauuuagaugauuucuaauuua

SEQ ID NO: 853 - RNA, 36 nt, Nitratifractor salsuginis
uguaacaggguaggguuuuuugaggggucuuaaaau

SEQ ID NO: 854 - RNA, 36 nt, Butyrivibrio fibrisolvens
aguuucuaaucacuuaauuuuuucggaccuacuaaa

SEQ ID NO: 855 - RNA, 36 nt, Streptobacillus moniliformis
gauucacauuauucaaguuuacuacagauucuguau

SEQ ID NO: 856 - RNA, 36 nt, Mycoplasma mobile
aguuaagaauacauaagaaugauacaucacuaaaaa

SEQ ID NO: 857 - RNA, 44 nt, Capnocytophaga ochracea
auugugaauugcuuucaaauugugcgacaaaaguagguauaaua

SEQ ID NO: 858 - RNA, 36 nt, Acidovorax ebreus
auugcagcaacggcucucaccccggauaaccacaau

SEQ ID NO: 859 - RNA, 36 nt, Wolinella succinogenes
auagccgcugccuacucagccauuuagcgcagcgac

SEQ ID NO: 860 - RNA, 37 nt, Wolinella succinogenes
uuuguuaaagcuggaugggauuauuauagaguguugc

SEQ ID NO: 861 - RNA, 37 nt, Wolinella succinogenes
uuucaaggcaucgaacggauuugcuauaaaguguugc

SEQ ID NO: 862 - RNA, 36 nt, Prevotella ruminicola
uuuugcacacguaagauuccuacaucuuaucacaau

SEQ ID NO: 863 - RNA, 48 nt, Fibrobacter succinogenes
auugugaauugcuuucagauuaugaaaauaauauaguuaaaauuuuug

SEQ ID NO: 864 - RNA, 36 nt, Campylobacter jejuni
auuuuauuucgauuuuaaucaacccuaaauuucaau

SEQ ID NO: 865 - RNA, 36 nt, Campylobacter jejuni
auuuuagucccuuuuuaaauuucuuaugagauuaua

SEQ ID NO: 866 - RNA, 25 nt, Campylobacter jejuni
aagaaauuuaaaaagggacuaaaau

SEQ ID NO: 867 - RNA, 36 nt, Pasteurella multocida
auuguagcaacgucucucauuucgcagugcaacaau

SEQ ID NO: 868 - RNA, 36 nt, Rhodopseudomonas palustris
gccguggcuuuccuaccgauuucccaccgcaugauu

SEQ ID NO: 869 - RNA, 36 nt, Olsenella uli
ucugaauuaccagucagaacgauacugcgagucaaa

SEQ ID NO: 870 - RNA, 36 nt, Rhodospirillum rubrum
guuccauggccccgucccacacgccaugauagagcg

SEQ ID NO: 871 - RNA, 36 nt, Rhodospirillum rubrum
aaacgggagaaccgucccacacggccaugguagagu

SEQ ID NO: 872 - RNA, 36 nt, Dinoroseobacter shibae
uuaacggcucgaccgcgaauucugaacguaaagaca

SEQ ID NO: 873 - RNA, 36 nt, Verminephrobacter eiseniae
uuagcguccagagcgcauaucccagugagauauccg

SEQ ID NO: 874 - RNA, 75 nt, Streptococcus pyogenes
aaacagcauagcaaguuaaaauaaggcuaguccguuaucaacuugaaaaaguggcaccgagucggugcuuuuuuu

SEQ ID NO: 875 - RNA, 77 nt, Listeria innocua
aaauaacauagcaaguuaaaauaaggcuuuguccguuaucaacuuuuaauuaaguagcgcuguuucggcgcuuuuuu

SEQ ID NO: 876 - RNA, 73 nt, Artificial Sequence
  synthetic sequence
aacagcauagcaaguuaaaauaaggcuaguccguuaucaacuugaaaaaguggcaccgagucggugcuuuuuu

SEQ ID NO: 877 - RNA, 33 nt, Francisella novicida
uauaaauguaccaaauaauuaaugcucuguaau

SEQ ID NO: 878 - RNA, 74 nt, Campylobacter jejuni
aagaaauuuaaaaagggacuaaaauaaagaguuugcgggacucugcgggguuacaauccccuaaaaccgcuuuu

SEQ ID NO: 879 - RNA, 96 nt, Francisella novicida
aucuaaaauuauaaauguaccaaauaauuaaugcucuguaaucauuuaaaaguauuuugaacggaccucuguuugacacgucugaauaacuaaaaa

SEQ ID NO: 880 - RNA, 109 nt, Streptococcus thermophilus2
uguaagggacgccuuacacaguuacuuaaaucuugcagaagcuacaaagauaaggcuucaugccgaaaucaacacccugucauuuuauggcaggguguuuucguuauuu

SEQ ID NO: 881 - RNA, 110 nt, Mycoplasma mobile
uguauuucgaaauacagauguacaguuaagaauacauaagaaugauacaucacuaaaaaaaggcuuuaugccguaacuacuacuuauuuucaaaauaaguaguuuuuuuu

SEQ ID NO: 882 - RNA, 92 nt, Listeria innocua
auuguuaguauucaaaauaacauagcaaguuaaaauaaggcuuuguccguuaucaacuuuuaauuaaguagcgcuguuucggcgcuuuuuuu

SEQ ID NO: 883 - RNA, 89 nt, Streptococcus pyogenes
guuggaaccauucaaaacagcauagcaaguuaaaauaaggcuaguccguuaucaacuugaaaaaguggcaccgagucggugcuuuuuuu

SEQ ID NO: 884 - RNA, 107 nt, Streptococcus mutans
guuggaaucauucgaaacaacacagcaaguuaaaauaaggcagugauuuuuaauccaguccguacacaacuugaaaaagugcgcaccgauucggugcuuuuuuauuu

SEQ ID NO: 885 - RNA, 96 nt, Streptococcus thermophilus
uugugguuugaaaccauucgaaacaacacagcgaguuaaaauaaggcuuaguccguacucaacuugaaaagguggcaccgauucgguguuuuuuuu

SEQ ID NO: 886 - RNA, 102 nt, Neisseria meningitidis
acauauugucgcacugcgaaaugagaaccguugcuacaauaaggccgucugaaaagaugugccgcaacgcucugccccuuaaagcuucugcuuuaaggggca

SEQ ID NO: 887 - RNA, 110 nt, Pasteurella multocida; identical to SEQ ID NO: 835

SEQ ID NO: 888 - RNA, 37 nt, Francisella novicida
aacacaaguacauaccaaauaaucuaacaacugaaac

SEQ ID NO: 889 - RNA, 37 nt, Francisella novicida
aaauuauaaauguaccaaauaauuaaugcucuguaau

SEQ ID NO: 890 - RNA, 37 nt, Wolinella succinogenes; identical to SEQ ID NO: 861

SEQ ID NO: 891 - RNA, 37 nt, Wolinella succinogenes; identical to SEQ ID NO: 860

SEQ ID NO: 892 - RNA, 37 nt, gamma proteobacterium
auuucaguguauagaauguugggaugcauucugaaua

SEQ ID NO: 893 - RNA, 37 nt, gamma proteobacterium
auaacaagggaguauuugcuggaauaagcucugaaac

SEQ ID NO: 894 - RNA, 37 nt, Sutterella wadsworthensis
guuuccaagcaauagcucguggcguuaugauuucugu

SEQ ID NO: 895 - RNA, 37 nt, Sutterella wadsworthensis
ggugauuuccuauagcucauagcguuaugaucucuaa

SEQ ID NO: 896 - RNA, 37 nt, Legionella pneumophila; identical to SEQ ID NO: 852

SEQ ID NO: 897 - RNA, 36 nt, Listeria innocua; identical to SEQ ID NO: 842

SEQ ID NO: 898 - RNA, 36 nt, Streptococcus thermophilus; identical to SEQ ID NO: 840

SEQ ID NO: 899 - RNA, 36 nt, Streptococcus mutans; identical to SEQ ID NO: 839

SEQ ID NO: 900 - RNA, 36 nt, Streptococcus pyogenes; identical to SEQ ID NO: 838

SEQ ID NO: 901 - RNA, 36 nt, Fusobacterium nucleatum
auuuuuaauuuaaguaauaaaaaauggagcauauac

SEQ ID NO: 902 - RNA, 36 nt, Filifactor alocis
aguugacuaccauaugagauuacacuacacgguuca

SEQ ID NO: 903 - RNA, 36 nt, Treponema denticola; identical to SEQ ID NO: 844

SEQ ID NO: 904 - RNA, 36 nt, Solobacterium moorei
cuuauaccaguaagauaauuuacauaguaaguucaa

SEQ ID NO: 905 - RNA, 36 nt, Veillonella atypica
guuuuggagguuuacagaauuacacuacgaguucaa

SEQ ID NO: 906 - RNA, 36 nt, Finegoldia magna
guuuaauaccuauaugagauuacaucaugaguucaa

SEQ ID NO: 907 - RNA, 36 nt, Olsenella uli; identical to SEQ ID NO: 869

SEQ ID NO: 908 - RNA, 36 nt, Lactobacillus rhamnosus
caacuugaauugauugaucugacaucuacgaguuga

SEQ ID NO: 909 - RNA, 36 nt, Lactobacillus gasseri
ugauuagauuucauugaucuaacagccaucuaaaac

SEQ ID NO: 910 - RNA, 36 nt, Lactobacillus gasseri
acacuaaacuuuauugaucuaacaaccagauuuaaa

SEQ ID NO: 911 - RNA, 36 nt, Oenococcus kitaharae
ggguucuaccucauugaucugacacacagcauugaa

SEQ ID NO: 912 - RNA, 36 nt, Bifidobacterium bifidum; identical to SEQ ID NO: 848

SEQ ID NO: 913 - RNA, 36 nt, Staphylococcus pseudintermedius
guuuuacuucuuucuaaauaaacauaguuaaguuaa

SEQ ID NO: 914 - RNA, 36 nt, Eubacterium rectale
auuuuauagucacguaaauuuuucagaucuacuaaa

SEQ ID NO: 915 - RNA, 38 nt, Enterococcus faecalis
auuuuacugauaagaaauuauugagaaucuacaaaaau

SEQ ID NO: 916 - RNA, 36 nt, Streptococcus thermophilus; identical to SEQ ID NO: 841

SEQ ID NO: 917 - RNA, 36 nt, Staphylococcus lugdunensis
cuuguacuuauaccuaaaauuacagaaucuacugaa

SEQ ID NO: 918 - RNA, 36 nt, Eubacterium dolichum
aucauaaucuagcaaaaguuuauaugaucuaacaaa

SEQ ID NO: 919 - RNA, 36 nt, Mycoplasma mobile; identical to SEQ ID NO: 856

SEQ ID NO: 920 - RNA, 36 nt, Mycoplasma ovipneumoniae
auuuuacucuaguaagaaauugucgcacaaaaauaa

SEQ ID NO: 921 - RNA, 36 nt, Mycoplasma gallisepticum
auuauugcuuacacaauuauugucgugcuaaaauaa

SEQ ID NO: 922 - RNA, 36 nt, Mycoplasma canis
auuauuguuuacccaaauauuguacauccuaaauca

SEQ ID NO: 923 - RNA, 36 nt, Mycoplasma synoviae
uacuuacuuaacaaaauaauuguacgauuccaaaau

SEQ ID NO: 924 - RNA, 36 nt, Aminomonas paucivorans
gccuucccucccugccgaaggagcagauccucuccu

SEQ ID NO: 925 - RNA, 36 nt, Clostridium perfringens
uuauaguaacuaguuaaacucucgauaugcuauacc

SEQ ID NO: 926 - RNA, 36 nt, Clostridium cellulolyticum
auuauagcaacaauucaggcuccgauaugccauaau

SEQ ID NO: 927 - RNA, 36 nt, Acidovorax ebreus; identical to SEQ ID NO: 858

SEQ ID NO: 928 - RNA, 36 nt, Neisseria meningitidis; identical to SEQ ID NO: 845

SEQ ID NO: 929 - RNA, 36 nt, Pasteurella multocida
auuguugcacugcgaaaugagagacguugcuacaau

SEQ ID NO: 930 - RNA, 36 nt, phylotype Rs-D17
uuuguaacuuaucugagagaggaugguuauuauaau

SEQ ID NO: 931 - RNA, 36 nt, Wolinella succinogenes; identical to SEQ ID NO: 859

SEQ ID NO: 932 - RNA, 36 nt, Campylobacter jejuni
auaauacaaaaaucauuuuuuuaaacaaacauaaac

SEQ ID NO: 933 - RNA, 36 nt, Campylobacter jejuni
uauaaucucauaagaaauuuaaaaagggacuaaaau

SEQ ID NO: 934 - RNA, 36 nt, Helicobacter mustelae
guauuugucaauaaauauacuuuauaauggcaagau

SEQ ID NO: 935 - RNA, 36 nt, Roseburia intestinalis
uuguaauaaccuaauuaucacuugguaugauauaau

SEQ ID NO: 936 - RNA, 36 nt, Lactobacillus coryniformis
uuuuauucuauaguaaguuuucagcuaaaauagauc

SEQ ID NO: 937 - RNA, 36 nt, Rhodopseudomonas palustris; identical to SEQ ID NO: 868

SEQ ID NO: 938 - RNA, 36 nt, Cand. Puniceispirillum marinum
uaaccauaggcuccucaaucaccagaguguuauugc

SEQ ID NO: 939 - RNA, 36 nt, Verminephrobacter eiseniae; identical to SEQ ID NO: 873

SEQ ID NO: 940 - RNA, 36 nt, Ralstonia syzygii
guuaguagcaaagcgcaauucccgaucugcuggaaa

SEQ ID NO: 941 - RNA, 36 nt, Azospirillum B510
uuaacggcuggacccccgauccccaucgaauuucca

SEQ ID NO: 942 - RNA, 36 nt, Dinoroseobacter shibae; identical to SEQ ID NO: 872

SEQ ID NO: 943 - RNA, 36 nt, Rhodospirillum rubrum; identical to SEQ ID NO: 870

SEQ ID NO: 944 - RNA, 36 nt, Rhodospirillum rubrum; identical to SEQ ID NO: 871

SEQ ID NO: 945 - RNA, 36 nt, Spirochaeta Buddy
auuagagauaaucgcugguuuuuguuaagauauaac

SEQ ID NO: 946 - RNA, 36 nt, Prevotella ruminicola; identical to SEQ ID NO: 862

SEQ ID NO: 947 - RNA, 36 nt, Flavobacterium columnare
agauaaaauuauucuaaucuuuaaucuuaucacaau

SEQ ID NO: 948 - RNA, 36 nt, Parvibaculum lavamentivorans
cuugcgaaaagcgaccgccucucgauuugcuacaga

SEQ ID NO: 949 - RNA, 44 nt, Capnocytophaga ochracea; identical to SEQ ID NO: 857

SEQ ID NO: 950 - RNA, 48 nt, Fibrobacter succinogenes; identical to SEQ ID NO: 863

SEQ ID NO: 951 - RNA, 36 nt, Nitratifractor salsuginis; identical to SEQ ID NO: 853

SEQ ID NO: 952 - RNA, 36 nt, Akkermansia muciniphila
cuuauacgggaacuccacgauaaggcauuuuacaug

SEQ ID NO: 953 - RNA, 88 nt, Artificial Sequence
  synthetic sequence
uuggaaccauucaaaacagcauagcaaguuaaaauaaggcuaguccguuaucaacuugaaaaaguggcaccgagucggugcuuuuuuu

SEQ ID NO: 954 - RNA, 77 nt, Artificial Sequence
  synthetic sequence
caaaacagcauagcaaguuaaaauaaggcuaguccguuaucaacuugaaaaaguggcaccgagucggugcuuuuuuu

SEQ ID NO: 955 - RNA, 61 nt, Artificial Sequence
  synthetic sequence
caaaacagcauagcaaguuaaaauaaggcuaguccguuaucaacuugaaaaaguuuuuuuu

SEQ ID NO: 956 - RNA, 44 nt, Artificial Sequence
  synthetic sequence
caaaacagcauagcaaguuaaaauaaggcuaguccguuuuuuuu

SEQ ID NO: 957 - RNA, 72 nt, Artificial Sequence
  synthetic sequence
caaaacagcauagcaaguuaaaauaaggcuaguccgguucacugccguauaggcagcuaagaaauuuuuuuu

SEQ ID NO: 958 - RNA, 14 nt, Artificial Sequence
  synthetic sequence
uagcaaguuaaaau

SEQ ID NO: 959 - RNA, 102 nt, Artificial Sequence
  synthetic sequence
  misc_feature (1)..(80): n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcuaugcuguuuug

SEQ ID NO: 960 - RNA, 102 nt, Artificial Sequence
  synthetic sequence
  misc_feature (1)..(80): n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcuauguuauuuug

SEQ ID NO: 961 - RNA, 92 nt, exemplary
  misc_feature (1)..(80): n is a, c, g, or u
nnnnnnnnnnnnnnnnnnnnnnnnnnnnnnnnnnnnnnnnnnnnnnnnnnnnnnnnnnnnnnnnnnnnnnnnnnnnnnnnguuuuagagcua

SEQ ID NO: 962 - RNA, 152 nt, Artificial Sequence
  synthetic sequence
  misc_feature (37)..(116): n is a, c, g, or u
guuuuagagcuaugcuguuuugaauggucccaaaacnnnnnnnnnnnnnnnnnnnnnnnnnnnnnnnnnnnnnnnnnnnnnnnnnnnnnnnnnnnnnnnnnnnnnnnnnnnnnnnnguuuuagagcuaugcuguuuugaauggucccaaaac

SEQ ID NO: 963 - RNA, 188 nt, Artificial Sequence
  synthetic sequence
  misc_feature (37)..(116): n is a, c, g, or u
guuuuagagcuaugcuguuuugaauggucccaaaacnnnnnnnnnnnnnnnnnnnnnnnnnnnnnnnnnnnnnnnnnnnnnnnnnnnnnnnnnnnnnnnnnnnnnnnnnnnnnnnnguuuuagagcuaugcuguuuugaauggucccaaaacguuuuagagcuaugcuguuuugaauggucccaaaac

SEQ ID NO: 964 - RNA, 22 nt, exemplary
guuuuagagcuaugcuguuuug

SEQ ID NO: 965 - RNA, 36 nt, Streptococcus pyogenes
guuuuagagcuaugcuguuuugaauggucccaaaac

SEQ ID NO: 966 - RNA, 36 nt, Pasteurella multocida
guuguaguucccucucucauuucgcagugcuacaau

SEQ ID NO: 967 - RNA, 36 nt, Mycoplasma mobile
guuuugguguaguaucauucuuauguauucuuaaac

SEQ ID NO: 968 - RNA, 37 nt, Francisella novicida
guuucaguugcugaauuauuugguaaacuacuguuag

SEQ ID NO: 969 - RNA, 33 nt, Francisella novicida
guuucaguugcugaauuauuugguaaacuacug

SEQ ID NO: 970 - RNA, 36 nt, Streptococcus mutans
guuuuagagcuguguuguuucgaaugguuccaaaac

SEQ ID NO: 971 - RNA, 36 nt, Streptococcus thermophilus; identical to SEQ ID NO: 970

SEQ ID NO: 972 - RNA, 36 nt, Streptococcus thermophilus
guuuuuguacucucaagauuuaaguaacuguacaac

SEQ ID NO: 973 - RNA, 36 nt, Listeria innocua
guuuuagagcuauguuauuuugaaugcuaacaaaac

SEQ ID NO: 974 - RNA, 36 nt, Treponema denticola
guuugagaguuguguaauuuaagauggaucucaaac

SEQ ID NO: 975 - RNA, 36 nt, Neisseria meningitidis
guuguagcucccuuucucauuucgcagugcuacaau

SEQ ID NO: 976 - RNA, 36 nt, Streptococcus gordonii; identical to SEQ ID NO: 972

SEQ ID NO: 977 - RNA, 35 nt, Bifidobacterium bifidum
guuucaaugccugucagaucaaugacuuugaccac

SEQ ID NO: 978 - RNA, 36 nt, Lactobacillus salivarius
guuucagaaguauguuaaaucaauaagguuaagacc

SEQ ID NO: 979 - RNA, 37 nt, Francisella novicida
cuaacaguaguuuaccaaauaauucagcaacugaaac

SEQ ID NO: 980 - RNA, 37 nt, Francisella novicida; identical to SEQ ID NO: 979

SEQ ID NO: 981 - RNA, 37 nt, Legionella pneumophila
ccaauaaucccucaucuaaaaauccaaccacugaaac

SEQ ID NO: 982 - RNA, 36 nt, Nitratifractor salsuginis
guuuuaagaccccucaaaaccccacccuguuacaau

SEQ ID NO: 983 - RNA, 36 nt, Butyrivibrio fibrisolvens
guuuuaguacccgggaaaauuaagugauuggaaaac

SEQ ID NO: 984 - RNA, 36 nt, Streptobacillus moniliformis
gauacagauucuugguaaauuugaauaaugugaaug

SEQ ID NO: 985 - RNA, 36 nt, Mycoplasma mobile; identical to SEQ ID NO: 967

SEQ ID NO: 986 - RNA, 44 nt, Capnocytophaga ochracea
uguuaucaaucgcaaaacuacaaaauuugaaagcaauucacaac

SEQ ID NO: 987 - RNA, 36 nt, Acidovorax ebreus
aguguagcuauccggggugagagagggagcuacaac

SEQ ID NO: 988 - RNA, 36 nt, Wolinella succinogenes
auuauagcgaggaauggcugaguaggcggcuauaac

SEQ ID NO: 989 - RNA, 37 nt, Wolinella succinogenes
gcaacacuuuauagcaaauccgcuuagccugugaaac

SEQ ID NO: 990 - RNA, 37 nt, Wolinella succinogenes; identical to SEQ ID NO: 989

SEQ ID NO: 991 - RNA, 36 nt, Prevotella ruminicola
guugugguuugauguaggaaaggaaugauauacaac

SEQ ID NO: 992 - RNA, 48 nt, Fibrobacter succinogenes
guuguuauugcacuaguaaaacuagaaaaucugaaagcaauucacaac

SEQ ID NO: 993 - RNA, 36 nt, Campylobacter jejuni
auuuuaccauaaagaaauuuaaaaagggacuaaaac

SEQ ID NO: 994 - RNA, 36 nt, Campylobacter jejuni
guuuuagucccuuuuuaaauuucuuuaugguaaaau

SEQ ID NO: 995 - RNA, 36 nt, Pasteurella multocida
auuguagcacugcgaaaugagagagggaacuacaac

SEQ ID NO: 996 - RNA, 36 nt, Rhodopseudomonas palustris
agccuaccacggggaaaucgguagggaagccacggc

SEQ ID NO: 997 - RNA, 36 nt, Olsenella uli
guuuuggggcagugucguuuugacugguaaucaaac

SEQ ID NO: 998 - RNA, 36 nt, Rhodospirillum rubrum
acucuaccauggcggugugggacggggccauggaac

SEQ ID NO: 999 - RNA, 36 nt, Rhodospirillum rubrum; identical to SEQ ID NO: 998

SEQ ID NO: 1000 - RNA, 36 nt, Dinoroseobacter shibae
aguuuagcuguucagaauucgggguccagccgcaac

SEQ ID NO: 1001 - RNA, 36 nt, Verminephrobacter eiseniae
auuguagcucacugggauaugcgcacuggccggaac

SEQ ID NO: 1002 - RNA, 37 nt, Francisella novicida; identical to SEQ ID NO: 968

SEQ ID NO: 1003 - RNA, 37 nt, Francisella novicida; identical to SEQ ID NO: 968

SEQ ID NO: 1004 - RNA, 37 nt, Wolinella succinogenes; identical to SEQ ID NO: 989

SEQ ID NO: 1005 - RNA, 37 nt, Wolinella succinogenes; identical to SEQ ID NO: 989

SEQ ID NO: 1006 - RNA, 37 nt, gamma proteobacterium
guuucagagcuuaucccaacaaaccaacagcugaaac

SEQ ID NO: 1007 - RNA, 37 nt, gamma proteobacterium; identical to SEQ ID NO: 1006

SEQ ID NO: 1008 - RNA, 37 nt, Sutterella wadsworthensis
gcgaagaucauaacgcuacgagcuauagcacugaaac

SEQ ID NO: 1009 - RNA, 37 nt, Sutterella wadsworthensis; identical to SEQ ID NO: 1008

SEQ ID NO: 1010 - RNA, 37 nt, Legionella pneumophila; identical to SEQ ID NO: 981

SEQ ID NO: 1011 - RNA, 36 nt, Listeria innocua; identical to SEQ ID NO: 973

SEQ ID NO: 1012 - RNA, 36 nt, Streptococcus thermophilus; identical to SEQ ID NO: 970

SEQ ID NO: 1013 - RNA, 36 nt, Streptococcus mutans; identical to SEQ ID NO: 970

SEQ ID NO: 1014 - RNA, 36 nt, Streptococcus pyogenes; identical to SEQ ID NO: 965

SEQ ID NO: 1015 - RNA, 36 nt, Fusobacterium nucleatum
guuugagaguaauguuauuuuaaauagauucaaaac

SEQ ID NO: 1016 - RNA, 36 nt, Filifactor alocis
guuugagaguaguguaauuucauaugguagucaaac

SEQ ID NO: 1017 - RNA, 36 nt, Treponema denticola; identical to SEQ ID NO: 974

SEQ ID NO: 1018 - RNA, 36 nt, Solobacterium moorei
guuugagaacuauguaaauuaugcugguagcaaaac

SEQ ID NO: 1019 - RNA, 36 nt, Veillonella atypica
guuugcgaguaguguaauucuguaaaucucuaaaac

SEQ ID NO: 1020 - RNA, 36 nt, Finegoldia magna
guuugagaaugauguaauuucauauagguauuaaac

SEQ ID NO: 1021 - RNA, 36 nt, Olsenella uli; identical to SEQ ID NO: 997

SEQ ID NO: 1022 - RNA, 36 nt, Lactobacillus rhamnosus
gucucagguagaugucagaucaaucaguucaagagc

SEQ ID NO: 1023 - RNA, 36 nt, Lactobacillus gasseri
guuuuagaugguuguuagaucaauaagguuuagauc

SEQ ID NO: 1024 - RNA, 36 nt, Lactobacillus gasseri; identical to SEQ ID NO: 1023

SEQ ID NO: 1025 - RNA, 36 nt, Oenococcus kitaharae
gcuucagaugugugucagaucaaugagguagaaccc

SEQ ID NO: 1026 - RNA, 36 nt, Bifidobacterium bifidum
guuucagaugccugucagaucaaugacuuugaccac

SEQ ID NO: 1027 - RNA, 36 nt, Staphylococcus pseudintermedius
guuuuagcacuauguuuauuuagaaagagguaaaac

SEQ ID NO: 1028 - RNA, 36 nt, Eubacterium rectale
auuuuaguaacugaauaauuuacgugacuguaaaac

SEQ ID NO: 1029 - RNA, 36 nt, Enterococcus faecalis
guuuuuguauucucaauaauuucuuaucaguaaaac

SEQ ID NO: 1030 - RNA, 36 nt, Streptococcus thermophilus; identical to SEQ ID NO: 972

SEQ ID NO: 1031 - RNA, 36 nt, Staphylococcus lugdunensis
guuuuaguacucuguaauuuuagguauaagugauac

SEQ ID NO: 1032 - RNA, 36 nt, Eubacterium dolichum
guuuuguuaccauauggauuuuugcuagauuaagac

SEQ ID NO: 1033 - RNA, 36 nt, Mycoplasma mobile; identical to SEQ ID NO: 967

SEQ ID NO: 1034 - RNA, 36 nt, Mycoplasma ovipneumoniae
guuuuugugcuguacaauuucuuacuagaguaaaac

SEQ ID NO: 1035 - RNA, 36 nt, Mycoplasma gallisepticum
guuuuagcacuguacaauacuuguguaagcaauaac

SEQ ID NO: 1036 - RNA, 36 nt, Mycoplasma canis
guuuuaguguuguacaauauuuggguaaacaauaac

SEQ ID NO: 1037 - RNA, 36 nt, Mycoplasma synoviae
guuuugggguuguacaauuauuuuguuaaguaaaac

SEQ ID NO: 1038 - RNA, 36 nt, Aminomonas paucivorans
agcauagcauuucggagugcggcagggagcuaugac

SEQ ID NO: 1039 - RNA, 36 nt, Clostridium perfringens
auuauagcauaucgagaauuuacuaggaacuauaac

SEQ ID NO: 1040 - RNA, 36 nt, Clostridium cellulolyticum
auuauagcauaucggagccugaauuggagcuauaac

SEQ ID NO: 1041 - RNA, 36 nt, Acidovorax ebreus; identical to SEQ ID NO: 987

SEQ ID NO: 1042 - RNA, 36 nt, Neisseria meningitidis; identical to SEQ ID NO: 975

SEQ ID NO: 1043 - RNA, 36 nt, Pasteurella multocida; identical to SEQ ID NO: 966

SEQ ID NO: 1044 - RNA, 36 nt, phylotype Rs-D17
guuauaguuuccuuccucucucagaugugcuauaau

SEQ ID NO: 1045 - RNA, 36 nt, Wolinella succinogenes; identical to SEQ ID NO: 988

SEQ ID NO: 1046 - RNA, 36 nt, Campylobacter jejuni; identical to SEQ ID NO: 994

SEQ ID NO: 1047 - RNA, 36 nt, Campylobacter jejuni; identical to SEQ ID NO: 994

SEQ ID NO: 1048 - RNA, 36 nt, Helicobacter mustelae
auuuuagcauaaacauauuuaugaaguggcuaaaac

SEQ ID NO: 1049 - RNA, 36 nt, Roseburia intestinalis
auuauaccauaccaagugauaacagggaauuacaac

SEQ ID NO: 1050 - RNA, 36 nt, Lactobacillus coryniformis
gaucuauuuuagcugaaaacugaaggaaucaauagc

SEQ ID NO: 1051 - RNA, 36 nt, Rhodopseudomonas palustris; identical to SEQ ID NO: 996

SEQ ID NO: 1052 - RNA, 36 nt, Cand. Puniceispirillum marinum
aguauagcacucuggugauugagagccuagagcaac

SEQ ID NO: 1053 - RNA, 36 nt, Verminephrobacter eiseniae; identical to SEQ ID NO: 1001

SEQ ID NO: 1054 - RNA, 36 nt, Ralstonia syzygii
agguuagcagaucgggaauugcgcucuggcuacaac

SEQ ID NO: 1055 - RNA, 36 nt, Azospirillum B510
aguguagccgauggggaucggggguccagccgcaac

SEQ ID NO: 1056 - RNA, 36 nt, Dinoroseobacter shibae; identical to SEQ ID NO: 1000

SEQ ID NO: 1057 - RNA, 36 nt, Rhodospirillum rubrum; identical to SEQ ID NO: 998

SEQ ID NO: 1058 - RNA, 36 nt, Rhodospirillum rubrum; identical to SEQ ID NO: 998

SEQ ID NO: 1059 - RNA, 36 nt, Spirochaeta Buddy
ggucaaucuuaacaaaaaucagcggucauccccaac

SEQ ID NO: 1060 - RNA, 36 nt, Prevotella ruminicola; identical to SEQ ID NO: 991

SEQ ID NO: 1061 - RNA, 36 nt, Flavobacterium columnare
guugugguuugauuaaagauuagaaaacacgauauu

SEQ ID NO: 1062 - RNA, 36 nt, Parvibaculum lavamentivorans
agaguagcaaaucgagagacggccgcaauccgcagc

SEQ ID NO: 1063 - RNA, 44 nt, Capnocytophaga ochracea; identical to SEQ ID NO: 986

SEQ ID NO: 1064 - RNA, 48 nt, Fibrobacter succinogenes; identical to SEQ ID NO: 992

SEQ ID NO: 1065 - RNA, 36 nt, Nitratifractor salsuginis; identical to SEQ ID NO: 982

SEQ ID NO: 1066 - RNA, 36 nt, Akkermansia muciniphila
guuguacugugccuuauuuuggauucaaggcaaaac

SEQ ID NO: 1067 - RNA, 44 nt, Artificial Sequence
  synthetic sequence
guuuuagagcuagaaauagcaaguuaaaauaaggcuaguccguu

SEQ ID NO: 1068 - RNA, 60 nt, Artificial Sequence
  synthetic sequence
  misc_feature (13)..(17): n is a, c, g, or u
guuuuagagcuannnnnuagcaaguuaaaauaaguuaaaauaaggcuaguccguuaucaa

SEQ ID NO: 1069 - RNA, 68 nt, Artificial Sequence
  synthetic sequence
guuuuagagcuaugcugaaaagcauagcaaguuaaaaauaaguuaaaauaaggcuaguccguuaucaa

SEQ ID NO: 1070 - RNA, 69 nt, Artificial Sequence
  synthetic sequence
guuuuagagcuaugcuguuuuggaaacaaaacagcauagcaaguuaaaauaaggcuaguccguuaucaa

SEQ ID NO: 1071 - RNA, 70 nt, Artificial Sequence
  synthetic sequence
guuuuagagcuaguuuuagagcuagaaauagcaaguuaaaauuagcaaguuaaaauaaggcuaguccguu

SEQ ID NO: 1072 - RNA, 70 nt, Artificial Sequence
  synthetic sequence
guuuuagagcuauagcaaguuaaaaugaaaguuuuagagcuauagcaaguuaaaauaaggcuaguccguu

SEQ ID NO: 1073 - RNA, 74 nt, Artificial Sequence
  synthetic sequence
guuuuagagcuagaaauagcaaguuaaaauguuuuagagcuagaaauagcaaguuaaaauaaggcuaguccguu

SEQ ID NO: 1074 - RNA, 119 nt, Artificial Sequence
  synthetic sequence
guuuuagagcuaugcuguuuuggaaacaaaacagcauagcaaguuaaaauguuuuagagcuaugcuguuuuggaaacaaaacagcauagcaaguuaaaauaaggcuaguccguuaucaa

SEQ ID NO: 1075 - RNA, 12 nt, Artificial Sequence
  synthetic sequence
guuuuagagcua

SEQ ID NO: 1076 - protein, 11 aa, Artificial Sequence
  synthetic sequence
YGRKKRRQRRR

SEQ ID NO: 1077 - protein, 12 aa, Artificial Sequence
  synthetic sequence
RRQRRTSKLMKR

SEQ ID NO: 1078 - protein, 27 aa, Artificial Sequence
  synthetic sequence
GWTLNSAGYLLGKINLKALAALAKKIL

SEQ ID NO: 1079 - protein, 33 aa, Artificial Sequence
  synthetic sequence
KALAWEAKLAKALAKALAKHLAKALAKALKCEA

SEQ ID NO: 1080 - protein, 16 aa, Artificial Sequence
  synthetic sequence
RQIKIWFQNRRMKWKK

SEQ ID NO: 1081 - protein, 11 aa, Artificial Sequence
  synthetic sequence
YGRKKRRQRRR

SEQ ID NO: 1082 - protein, 9 aa, Artificial Sequence
  synthetic sequence
RKKRRQRRR

SEQ ID NO: 1083 - protein, 11 aa, Artificial Sequence
  synthetic sequence
YGRKKRRQRRR

SEQ ID NO: 1084 - protein, 8 aa, Artificial Sequence
  synthetic sequence
RKKRRQRR

SEQ ID NO: 1085 - protein, 11 aa, Artificial Sequence
  synthetic sequence
YARAAARQARA

SEQ ID NO: 1086 - protein, 11 aa, Artificial Sequence
  synthetic sequence
THRLPRRRRRR

SEQ ID NO: 1087 - protein, 11 aa, Artificial Sequence
  synthetic sequence
GGRRARRRRRR

SEQ ID NO: 1088 - protein, 1300 aa, Francisella  tularensis
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKNVYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 1089 - protein, 1307 aa, unknown
  synthetic sequence
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 1090 - protein, 1246 aa, unknown
  synthetic sequence
MLKNVGIDRLDVEKGRKNMSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 1091 - protein, 1246 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSESEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQIIGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 1092 - protein, 1326 aa, Prevotella  disiens
MKVMENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIKALKGFYIEDGFENNVLTPLATLLSSLDKYNLNGIFIRNNEALSSLSQNVYRNFSIDEAIDANAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNDKKLNLSISSTEWLDFVREKPYLK

SEQ ID NO: 1093 - RNA, 19 nt, Artificial Sequence
  synthetic sequence
aauuucuacuguuguagau

SEQ ID NO: 1094 - RNA, 19 nt, Artificial Sequence
  synthetic sequence
aauuucugcuguugcagau

SEQ ID NO: 1095 - RNA, 19 nt, Artificial Sequence
  synthetic sequence
aauuuccacuguuguggau

SEQ ID NO: 1096 - RNA, 19 nt, Artificial Sequence
  synthetic sequence
aauuccuacuguuguaggu

SEQ ID NO: 1097 - RNA, 19 nt, Artificial Sequence
  synthetic sequence
aauuucuacuauuguagau

SEQ ID NO: 1098 - RNA, 19 nt, Artificial Sequence
  synthetic sequence
aauuucuacugcuguagau

SEQ ID NO: 1099 - RNA, 18 nt, Artificial Sequence
  synthetic sequence
aauuucuacuuuguagau

SEQ ID NO: 1100 - RNA, 17 nt, Artificial Sequence
  synthetic sequence
aauuucuacuuguagau

SEQ ID NO: 1101 - RNA, 67 nt, Artificial Sequence
  synthetic sequence
gaauuuuucaacgggugugccaauggccacuuuccagguggcaaagcccguugagcuucucaaaaag

SEQ ID NO: 1102 - RNA, 79 nt, Artificial Sequence
  synthetic sequence
gucuagaggacagaauuuuucaacgggugugccaauggccacuuuccagguggcaaagcccguugagcuucucaaaaag

SEQ ID NO: 1103 - RNA, 78 nt, Artificial Sequence
  synthetic sequence
ucuagaggacagaauuuuucaacgggugugccaauggccacuuuccagguggcaaagcccguugagcuucucaaaaag

SEQ ID NO: 1104 - RNA, 36 nt, Artificial Sequence
  synthetic sequence
acuuuccaggcaaagcccguugagcuucucaaaaag

SEQ ID NO: 1105 - RNA, 9 nt, Artificial Sequence
  synthetic sequence
agcuucuca

SEQ ID NO: 1106 - RNA, 8 nt, Artificial Sequence
  synthetic sequence
gcuucuca

SEQ ID NO: 1107 - RNA, 34 nt, Artificial Sequence
  synthetic sequence
  misc_feature (15)..(34): n is a, c, g, or u
cugagaaguggcacnnnnnnnnnnnnnnnnnnnn

SEQ ID NO: 1108 - RNA, 14 nt, Artificial Sequence
  synthetic sequence
cugagaaguggcac

SEQ ID NO: 1109 - RNA, 9 nt, Artificial Sequence
  synthetic sequence
cugagaagu

SEQ ID NO: 1110 - RNA, 13 nt, Artificial Sequence
  synthetic sequence
ugagaaguggcac

SEQ ID NO: 1111 - RNA, 8 nt, Artificial Sequence
  synthetic sequence
ugagaagu

SEQ ID NO: 1112 - protein, 1129 aa, Alicyclobacillus acidoterrestris
MAVKSIKVKLRLDDMPEIRAGLWKLHKEVNAGVRYYTEWLSLLRQENLYRRSPNGDGEQECDKTAEECKAELLERLRARQVENGHRGPAGSDDELLQLARQLYELLVPQAIGAKGDAQQIARKFLSPLADKDAVGGLGIAKAGNKPRWVRMREAGEPGWEEEKEKAETRKSADRTADVLRALADFGLKPLMRVYTDSEMSSVEWKPLRKGQAVRTWDRDMFQQAIERMMSWESWNQRVGQEYAKLVEQKNRFEQKNFVGQEHLVHLVNQLQQDMKEASPGLESKEQTAHYVTGRALRGSDKVFEKWGKLAPDAPFDLYDAEIKNVQRRNTRRFGSHDLFAKLAEPEYQALWREDASFLTRYAVYNSILRKLNHAKMFATFTLPDATAHPIWTRFDKLGGNLHQYTFLFNEFGERRHAIRFHKLLKVENGVAREVDDVTVPISMSEQLDNLLPRDPNEPIALYFRDYGAEQHFTGEFGGAKIQCRRDQLAHMHRRRGARDVYLNVSVRVQSQSEARGERRPPYAAVFRLVGDNHRAFVHFDKLSDYLAEHPDDGKLGSEGLLSGLRVMSVDLGLRTSASISVFRVARKDELKPNSKGRVPFFFPIKGNDNLVAVHERSQLLKLPGETESKDLRAIREERQRTLRQLRTQLAYLRLLVRCGSEDVGRRERSWAKLIEQPVDAANHMTPDWREAFENELQKLKSLHGICSDKEWMDAVYESVRRVWRHMGKQVRDWRKDVRSGERPKIRGYAKDVVGGNSIEQIEYLERQYKFLKSWSFFGKVSGQVIRAEKGSRFAITLREHIDHAKEDRLKKLADRIIMEALGYVYALDERGKGKWVAKYPPCQLILLEELSEYQFNNDRPPSENNQLMQWSHRGVFQELINQAQVHDLLVGTMYAAFSSRFDARTGAPGIRCRRVPARCTQEHNPEPFPWWLNKFVVEHTLDACPLRADDLIPTGEGEIFVSPFSAEEGDFHQIHADLNAAQNLQQRLWSDFDISQIRLRCDWGEVDGELVLIPRLTGKRTADSYSNKVFYTNTGVTYYERERGKKRRKVFAQEKLSEEEAELLVEADEAREKSVVLMRDPSGIINRGNWTRQKEFWSMVNQRIEGYLVKQIRSRVPLQDSACENTGDI

SEQ ID NO: 1113 - protein, 872 aa, Alicyclobacillus contaminans
MGFNTAELLRKVEEEMRKTSVGFDTDNPFAHRITRRAIRGWDRIAEAWRRLPPDAPESEYIEAFKDIQRKNPRKIGSEPLFKNLAAPGVRSELLNNPQVLITFAKYNELQRQLAKAKQFAQKTLPHPVFHPVWVRYDKLGGNLHHYQIEPAVHANDTHKVKFSSLLLPQEDGSYAEVKDVTVSLAPSLQFPTGLVHPKVTTPPRTGLVTVMDEEAGKPVVCYRDRGHDALVPVAFGGAKLQFNRAHLSAGYRKGVLSAGGGGSIYFNVTLDVQVPNERDVSKTFSFSRDRDLVSLKAEELKRYMETKPLGMPGVRVMSVDLGVRYGAAISVFEVKPFAEVRKDKLHYPITGCEGFVAEHERSVILKLPGEGVRTAGKQSERKQALAAIRAEMSILRKWLRVSQVTEEDRAKAVRGLLEDERGGGWTMDPGEDSDHQPLQQFLHEARLAVGELVNLVHLSPAEWERAVIERHRRLERITASHIRVFQTMRKVWGKRRNEDAAHTGGISLAHIEHLIQQRKLFIRWSTHARTYGEVRRLPKHEGFAKRLQKHTNHVKEDRIKKLADMIVMAARGYRFLDKRARWVKTRHAPCDLILFEDLSRYRFTMDRPPTENSQLMNWSHRELLKTVKMQAALFGIGVGTVPAAFTSRFDAQTGAPGLRCKRVTKQDKEKTPFWLIQFAEITGVNVTNVEPGQLIPVDGGEWFVSPKGPRAADGLKCVHADINAAHNLQRRFWIPRLPSVKCRRYVEAEGFAAVPSSTAFMKVHGKGAFVSVDGEFYEYQKGRRVAVNRADRTSSTLDEDEGDIGEEMLVSSNGAGEFVRMFYDESGYVGYGRWMDSKVFWGKVRQIVHRAIQDQVEKRAAARGENGATSSR

SEQ ID NO: 1114 - protein, 1149 aa, Desulfovibrio inopinatus
MPTRTINLKLVLGKNPENATLRRALFSTHRLVNQATKRIEEFLLLCRGEAYRTVDNEGKEAEIPRHAVQEEALAFAKAAQRHNGCISTYEDQEILDVLRQLYERLVPSVNENNEAGDAQAANAWVSPLMSAESEGGLSVYDKVLDPPPVWMKLKEEKAPGWEAASQIWIQSDEGQSLLNKPGSPPRWIRKLRSGQPWQDDFVSDQKKKQDELTKGNAPLIKQLKEMGLLPLVNPFFRHLLDPEGKGVSPWDRLAVRAAVAHFISWESWNHRTRAEYNSLKLRRDEFEAASDEFKDDFTLLRQYEAKRHSTLKSIALADDSNPYRIGVRSLRAWNRVREEWIDKGATEEQRVTILSKLQTQLRGKFGDPDLFNWLAQDRHVHLWSPRDSVTPLVRINAVDKVLRRRKPYALMTFAHPRFHPRWILYEAPGGSNLRQYALDCTENALHITLPLLVDDAHGTWIEKKIRVPLAPSGQIQDLTLEKLEKKKNRLYYRSGFQQFAGLAGGAEVLFHRPYMEHDERSEESLLERPGAVWFKLTLDVATQAPPNWLDGKGRVRTPPEVHHFKTALSNKSKHTRTLQPGLRVLSVDLGMRTFASCSVFELIEGKPETGRAFPVADERSMDSPNKLWAKHERSFKLTLPGETPSRKEEEERSIARAEIYALKRDIQRLKSLLRLGEEDNDNRRDALLEQFFKGWGEEDVVPGQAFPRSLFQGLGAAPFRSTPELWRQHCQTYYDKAEACLAKHISDWRKRTRPRPTSREMWYKTRSYHGGKSIWMLEYLDAVRKLLLSWSLRGRTYGAINRQDTARFGSLASRLLHHINSLKEDRIKTGADSIVQAARGYIPLPHGKGWEQRYEPCQLILFEDLARYRFRVDRPRRENSQLMQWNHRAIVAETTMQAELYGQIVENTAAGFSSRFHAATGAPGVRCRFLLERDFDNDLPKPYLLRELSWMLGNTKVESEEEKLRLLSEKIRPGSLVPWDGGEQFATLHPKRQTLCVIHADMNAAQNLQRRFFGRCGEAFRLVCQPHGDDVLRLASTPGARLLGALQQLENGQGAFELVRDMGSTSQMNRFVMKSLGKKKIKPLQDNNGDDELEDVLSVLPEEDDTGRITVFRDSSGIFFPCNVWIPAKQFWPAVRAMIWKVMASHSLG

SEQ ID NO: 1115 - protein, 1194 aa, Desulfonatronum thiodismutans
MVLGRKDDTAELRRALWTTHEHVNLAVAEVERVLLRCRGRSYWTLDRRGDPVHVPESQVAEDALAMAREAQRRNGWPVVGEDEEILLALRYLYEQIVPSCLLDDLGKPLKGDAQKIGTNYAGPLFDSDTCRRDEGKDVACCGPFHEVAGKYLGALPEWATPISKQEFDGKDASHLRFKATGGDDAFFRVSIEKANAWYEDPANQDALKNKAYNKDDWKKEKDKGISSWAVKYIQKQLQLGQDPRTEVRRKLWLELGLLPLFIPVFDKTMVGNLWNRLAVRLALAHLLSWESWNHRAVQDQALARAKRDELAALFLGMEDGFAGLREYELRRNESIKQHAFEPVDRPYVVSGRALRSWTRVREEWLRHGDTQESRKNICNRLQDRLRGKFGDPDVFHWLAEDGQEALWKERDCVTSFSLLNDADGLLEKRKGYALMTFADARLHPRWAMYEAPGGSNLRTYQIRKTENGLWADVVLLSPRNESAAVEEKTFNVRLAPSGQLSNVSFDQIQKGSKMVGRCRYQSANQQFEGLLGGAEILFDRKRIANEQHGATDLASKPGHVWFKLTLDVRPQAPQGWLDGKGRPALPPEAKHFKTALSNKSKFADQVRPGLRVLSVDLGVRSFAACSVFELVRGGPDQGTYFPAADGRTVDDPEKLWAKHERSFKITLPGENPSRKEEIARRAAMEELRSLNGDIRRLKAILRLSVLQEDDPRTEHLRLFMEAIVDDPAKSALNAELFKGFGDDRFRSTPDLWKQHCHFFHDKAEKVVAERFSRWRTETRPKSSSWQDWRERRGYAGGKSYWAVTYLEAVRGLILRWNMRGRTYGEVNRQDKKQFGTVASALLHHINQLKEDRIKTGADMIIQAARGFVPRKNGAGWVQVHEPCRLILFEDLARYRFRTDRSRRENSRLMRWSHREIVNEVGMQGELYGLHVDTTEAGFSSRYLASSGAPGVRCRHLVEEDFHDGLPGMHLVGELDWLLPKDKDRTANEARRLLGGMVRPGMLVPWDGGELFATLNAASQLHVIHADINAAQNLQRRFWGRCGEAIRIVCNQLSVDGSTRYEMAKAPKARLLGALQQLKNGDAPFHLTSIPNSQKPENSYVMTPTNAGKKYRAGPGEKSSGEEDELALDIVEQAEELAQGRKTFFRDPSGVFFAPDRWLPSEIYWSRIRRRIWQVTLERNSSGRQERAEMDEMPY

SEQ ID NO: 1116 - protein, 1132 aa, Tuberibacillus calidus
MATKSFILKMKTKNNPQLRLSLWKTHELFNFGVAYYMDLLSLFRQKDLYMHNDEDPDHPVVLKKEEIQERLWMKVRETQQKNGFHGEVSKDEVLETLRALYEELVPSAVGKSGEANQISNKYLYPLTDPASQSGKGTANSGRKPRWKKLKEAGDPSWKDAYEKWEKERQEDPKLKILAALQSFGLIPLFRPFTENDHKAVISVKWMPKSKNQSVRKFDKDMFNQAIERFLSWESWNEKVAEDYEKTVSIYESLQKELKGISTKAFEIMERVEKAYEAHLREITFSNSTYRIGNRAIRGWTEIVKKWMKLDPSAPQGNYLDVVKDYQRRHPRESGDFKLFELLSRPENQAAWREYPEFLPLYVKYRHAEQRMKTAKKQATFTLCDPIRHPLWVRYEERSGTNLNKYRLIMNEKEKVVQFDRLICLNADGHYEEQEDVTVPLAPSQQFDDQIKFSSEDTGKGKHNFSYYHKGINYELKGTLGGARIQFDREHLLRRQGVKAGNVGRIFLNVTLNIEPMQPFSRSGNLQTSVGKALKVYVDGYPKVVNFKPKELTEHIKESEKNTLTLGVESLPTGLRVMSVDLGQRQAAAISIFEVVSEKPDDNKLFYPVKDTDLFAVHRTSFNIKLPGEKRTERRMLEQQKRDQAIRDLSRKLKFLKNVLNMQKLEKTDEREKRVNRWIKDREREEENPVYVQEFEMISKVLYSPHSVWVDQLKSIHRKLEEQLGKEISKWRQSISQGRQGVYGISLKNIEDIEKTRRLLFRWSMRPENPGEVKQLQPGERFAIDQQNHLNHLKDDRIKKLANQIVMTALGYRYDGKRKKWIAKHPACQLVLFEDLSRYAFYDERSRLENRNLMRWSRREIPKQVAQIGGLYGLLVGEVGAQYSSRFHAKSGAPGIRCRVVKEHELYITEGGQKVRNQKFLDSLVENNIIEPDDARRLEPGDLIRDQGGDKFATLDERGELVITHADINAAQNLQKRFWTRTHGLYRIRCESREIKDAVVLVPSDKDQKEKMENLFGIGYLQPFKQENDVYKWVKGEKIKGKKTSSQSDDKELVSEILQEASVMADELKGNRKTLFRDPSGYVFPKDRWYTGGRYFGTLEHLLKRKLAERRLFDGGSSRRGLFNGTDSNTNVE

SEQ ID NO: 1117 - protein, 1108 aa, Bacillus thermoamylovorans
MATRSFILKIEPNEEVKKGLWKTHEVLNHGIAYYMNILKLIRQEAIYEHHEQDPKNPKKVSKAEIQAELWDFVLKMQKCNSFTHEVDKDVVFNILRELYEELVPSSVEKKGEANQLSNKFLYPLVDPNSQSGKGTASSGRKPRWYNLKIAGDPSWEEEKKKWEEDKKKDPLAKILGKLAEYGLIPLFIPFTDSNEPIVKEIKWMEKSRNQSVRRLDKDMFIQALERFLSWESWNLKVKEEYEKVEKEHKTLEERIKEDIQAFKSLEQYEKERQEQLLRDTLNTNEYRLSKRGLRGWREIIQKWLKMDENEPSEKYLEVFKDYQRKHPREAGDYSVYEFLSKKENHFIWRNHPEYPYLYATFCEIDKKKKDAKQQATFTLADPINHPLWVRFEERSGSNLNKYRILTEQLHTEKLKKKLTVQLDRLIYPTESGGWEEKGKVDIVLLPSRQFYNQIFLDIEEKGKHAFTYKDESIKFPLKGTLGGARVQFDRDHLRRYPHKVESGNVGRIYFNMTVNIEPTESPVSKSLKIHRDDFPKFVNFKPKELTEWIKDSKGKKLKSGIESLEIGLRVMSIDLGQRQAAAASIFEVVDQKPDIEGKLFFPIKGTELYAVHRASFNIKLPGETLVKSREVLRKAREDNLKLMNQKLNFLRNVLHFQQFEDITEREKRVTKWISRQENSDVPLVYQDELIQIRELMYKPYKDWVAFLKQLHKRLEVEIGKEVKHWRKSLSDGRKGLYGISLKNIDEIDRTRKFLLRWSLRPTEPGEVRRLEPGQRFAIDQLNHLNALKEDRLKKMANTIIMHALGYCYDVRKKKWQAKNPACQIILFEDLSNYNPYEERSRFENSKLMKWSRREIPRQVALQGEIYGLQVGEVGAQFSSRFHAKTGSPGIRCSVVTKEKLQDNRFFKNLQREGRLTLDKIAVLKEGDLYPDKGGEKFISLSKDRKLVTTHADINAAQNLQKRFWTRTHGFYKVYCKAYQVDGQTVYIPESKDQKQKIIEEFGEGYFILKDGVYEWGNAGKLKIKKGSSKQSSSELVDSDILKDSFDLASELKGEKLMLYRDPSGNVFPSDKWMAAGVFFGKLERILISKLTNQYSISTIEDDSSKQSM

SEQ ID NO: 1118 - protein, 1108 aa, unknown
  synthetic sequence
MAIRSIKLKLKTHTGPEAQNLRKGIWRTHRLLNEGVAYYMKMLLLFRQESTGERPKEELQEELICHIREQQQRNQADKNTQALPLDKALEALRQLYELLVPSSVGQSGDAQIISRKFLSPLVDPNSEGGKGTSKAGAKPTWQKKKEANDPTWEQDYEKWKKRREEDPTASVITTLEEYGIRPIFPLYTNTVTDIAWLPLQSNQFVRTWDRDMLQQAIERLLSWESWNKRVQEEYAKLKEKMAQLNEQLEGGQEWISLLEQYEENRERELRENMTAANDKYRITKRQMKGWNELYELWSTFPASASHEQYKEALKRVQQRLRGRFGDAHFFQYLMEEKNRLIWKGNPQRIHYFVARNELTKRLEEAKQSATMTLPNARKHPLWVRFDARGGNLQDYYLTAEADKPRSRRFVTFSQLIWPSESGWMEKKDVEVELALSRQFYQQVKLLKNDKGKQKIEFKDKGSGSTFNGHLGGAKLQLERGDLEKEEKNFEDGEIGSVYLNVVIDFEPLQEVKNGRVQAPYGQVLQLIRRPNEFPKVTTYKSEQLVEWIKASPQHSAGVESLASGFRVMSIDLGLRAAAATSIFSVEESSDKNAADFSYWIEGTPLVAVHQRSYMLRLPGEQVEKQVMEKRDERFQLHQRVKFQIRVLAQIMRMANKQYGDRWDELDSLKQAVEQKKSPLDQTDRTFWEGIVCDLTKVLPRNEADWEQAVVQIHRKAEEYVGKAVQAWRKRFAADERKGIAGLSMWNIEELEGLRKLLISWSRRTRNPQEVNRFERGHTSHQRLLTHIQNVKEDRLKQLSHAIVMTALGYVYDERKQEWCAEYPACQVILFENLSQYRSNLDRSTKENSTLMKWAHRSIPKYVHMQAEPYGIQIGDVRAEYSSRFYAKTGTPGIRCKKVRGQDLQGRRFENLQKRLVNEQFLTEEQVKQLRPGDIVPDDSGELFMTLTDGSGSKEVVFLQADINAAHNLQKRFWQRYNELFKVSCRVIVRDEEEYLVPKTKSVQAKLGKGLFVKKSDTAWKDVYVWDSQAKLKGKTTFTEESESPEQLEDFQEIIEEAEEAKGTYRTLFRDPSGVFFPESVWYPQKDFWGEVKRKLYGKLRERFLTKAR

SEQ ID NO: 1119 - protein, 658 aa, Methylobacterium nodulans
MLTKQDKQQKITYCTNMNEVFEAKLGSADLLLNWDHLRGRIRDRVDAGDIGSAFLKLALDVAHVLPDGVDDQLARAAFHFQSAKGAKSKHADSVQAGLRVLSIDLGVRSFATCSVFELKDTAPTTGVAFPLAEFRLWAVHERSFTLELPGENVGAAGQQWRAQADAELRQLRGGLNRHRQLLRAATVQKGERDAYLTDLREAWSAKELWPFEASLLSELERCSTVADPLWQDTCKRAARLYRTEFGAVVSEWRSRTRSREDRKYAGKSMWSVQHLTDVRRFLQSWSLAGRASGDIRRLDRERGGVFAKDLLDHIDALKDDRLKTGADLIVQAARGFQRNEFGYWVQKHAPCHVILFEDLSRYRMRTDRPRRENSQLMQWAHRGVPDMVGMQGEIYGIQDRRDPDSARKHARQPLAAFCLDTPAAFSSRYHASTMTPGIRCHPLRKREFEDQGFLELLKRENEGLDLNGYKPGDLVPLPGGEVFVCLNANGLSRIHADINAAQNLQRRFWTQHGDAFRLPCGKSAVQGQIRWAPLSMGKRQAGALGGFGYLEPTGHDSGSCQWRKTTEAEWRRLSGAQKDRDEAAAAEDEELQGLEEELLERSGERVVFFRDPSGVVLPTDLWFPSAAFWSIVRAKTVGRLRSHLDAQAEASYAVAAGL

SEQ ID NO: 1120 - protein, 1302 aa, unknown
  synthetic sequence
MKKFELKQNFRNNYSGKTLRNFRQTLAQIANKKSSDSILTIKFKLDCSKTGKLPKYENLISLYDTIEDIKKGTLSYYLFTLIVSGFKFFGSASQAKAFSTKDIFKDNDFYNQFKIQSHLDLPDFVPSKIYQRLKKNVRSTNGKDNAFKASVIVAEYRKEIGKLKNKDESSEHQCEELFKKIGTALETRFSSWQDLINNCSTGCEIIDEILNDSFGTLPSIKKMVLASTTQSSDGEQDGIAIAYDPDSTFIKSDELLNPYFAVATILKSMPPEIQQDKKSAYVKANLTTPTHNALSWIFGKGLTLFQTESTEKLCAMFNVSDKRVIEQVQDAAKAVKLPAELDLNHCTLKFQDFRSSLGGHLDSWTTNYLKRLDELNDLLLNLPKNLSLPDIFMIDGKDFIEYSGCNRDEIQQMIDFVVNEQNRIKLQESLNALLGKGNNQICSDDISTVKDFSEIVNSLHSFVQQIDNSLEQSSNEANSIFSELKKKIEKNEKWDIWKNNLKKIPKLNKLSGGVPDAWKEIREIEQKFHEISENQKKHFTEVMEWIDAGNGTIDIFESRFKYDELLKKSKKNNLQSADELAFRSVLNKLGRFARQGNDLVCEKIKNWFKEQNIFDSSKDFNRYFINQKGFIFKHPSSKKDNSPYNLSANLLEKRYEVTNTVGALLEQCESDPAIVNDPFSMRSLVEFRALWFSINISGISKEQHIPTKIAQPKLDDSTYQESVSPTLKYRLEKEQITSSELNSIFTVYKSLLSGLSIRLSRNSFYLRTKFSWIGNNSLIYCPKETTWKIPAAYFKSDLWNEYKDKQILIVNEEYDVDVVKTFESVYKIVKSKDNNEKNRILPLLKQLPHDWMFKLPFGASNAEKCKVLKLEKNNKKFKPLSVSKDSLARLSGPSTYFNQIDEIMMNDESELSEMTLLADEPVRQQMSNGKIEIIPDDYVMSLAIPITRSLKKGNTESFPFKNIVSIDQGEAGFAYAVFKLSDCGNERAEPIATGLIPIPSIRRLIHSVKKYRGKKQRIQNFNQKFDSTMFTLRENVTGDICGLIVALMKKYNAFPILEKQVGNLESGSKQLMLVYKAVNSKFLAAKVDMQNDQRRSWWYQGNSWNTPILRISNPNQSNNKNIVKNINGKKYEELKIYPGYSVSAYMTSCICHVCGRNALELLKNDDSTGKVKKYQINQDGEVTIGGEVIKLYRKPDRLTPVKNLAKKGNRERTYASINERAPTVSVQKAELSADELQKIIKKNMRRAPRSLMSKDTTQSRYFCVFKNCPCHNKEQHADVNAAINIGRRFLKDCILDDNKEKD

SEQ ID NO: 1121 - protein, 1255 aa, unknown
  synthetic sequence
MRSNYHGGRNARQWRKQISGLARRTKETVFTYKFPLETDAAEIDFDKAVQTYGIAEGVGHGSLIGLVCAFHLSGFRLFSKAGEAMAFRNRSRYPTDAFAEKLSAIMGIQLPTLSPEGLDLIFQSPPRSRDGIAPVWSENEVRNRLYTNWTGRGPANKPDEHLLEIAGEIAKQVFPKFGGWDDLASDPDKALAAADKYFQSQGDFPSIASLPAAIMLSPANSTVDFEGDYIAIDPAAETLLHQAVSRCAARLGRERPDLDQNKGPFVSSLQDALVSSQNNGLSWLFGVGFQHWKEKSPKELIDEYKVPADQHGAVTQVKSFVDAIPLNPLFDTTHYGEFRASVAGKVRSWVANYWKRLLDLKSLLATTEFTLPESISDPKAVSLFSGLLVDPQGLKKVADSLPARLVSAEEAIDRLMGVGIPTAADIAQVERVADEIGAFIGQVQQFNNQVKQKLENLQDADDEEFLKGLKIELPSGDKEPPAINRISGGAPDAAAEISELEEKLQRLLDARSEHFQTISEWAEENAVTLDPIAAMVELERLRLAERGATGDPEEYALRLLLQRIGRLANRVSPVSAGSIRELLKPVFMEEREFNLFFHNRLGSLYRSPYSTSRHQPFSIDVGKAKAIDWIAGLDQISSDIEKALSGAGEALGDQLRDWINLAGFAISQRLRGLPDTVPNALAQVRCPDDVRIPPLLAMLLEEDDIARDVCLKAFNLYVSAINGCLFGALREGFIVRTRFQRIGTDQIHYVPKDKAWEYPDRLNTAKGPINAAVSSDWIEKDGAVIKPVETVRNLSSTGFAGAGVSEYLVQAPHDWYTPLDLRDVAHLVTGLPVEKNITKLKRLTNRTAFRMVGASSFKTHLDSVLLSDKIKLGDFTIIIDQHYRQSVTYGGKVKISYEPERLQVEAAVPVVDTRDRTVPEPDTLFDHIVAIDLGERSVGFAVFDIKSCLRTGEVKPIHDNNGNPVVGTVAVPSIRRLMKAVRSHRRRRQPNQKVNQTYSTALQNYRENVIGDVCNRIDTLMERYNAFPVLEFQIKNFQAGAKQLEIVYGSVLHRYTFSGVDAHKAKRREYWYNGELWEHPYLMAKKWNEETNSMSGAPKPVSLFPGVTVNAARTSQICHQCQRNPMSHLRGLTGTIEISSDGLLELDDGTIRLFETSDYDEDKFKQSRREKRRLDANVLLSGRHRAEYIYTVAKRNLRRPPKNVMTKDTTQSRYTCLYKNCSWTGHADENAAINIGRRYLAERIDMPASKTKAAV

SEQ ID NO: 1122 - protein, 1266 aa, unknown
  synthetic sequence
MRPRFHGGMNARDWRKHVGVLAQQHKETTRTYTFPLDTTGSAIDFDAALQAYNAVEGVGYGSLLGLACAVHLSGFRLFSTGKEAATFRNRARYPNAAFQAALRKELGTTITTLTPETLDRLFSSRPKRRNGVPLPWNQDSIRDRLYTNWVKPRPGDTPDAVLFQIATGIAQEITEDVSSWTDLAKNSDRGLKAAHRYFARVGGFPAFDNLTPPATVQPTDTTIDYDPNAPFHLVSHADQTLIHQSISLCAHRIRQEDPALDPNKSGFIKQLQNNFLSQTFYGLSWLFGAGYVHFRECTANDLAIQYGIPNNCRDGIHQIKSFADAILPNTFFEKKHYRKDSRSVGKKAKSWISNYWQRLLQLQTWVDDHTWVTLPQELTEAQFKPLFRGLLVDAVELMAIAERLPQRLADCRDSLDCLMGKGPQAATKNDVEIVEKVREEIESFVGQIEQLGNQLRHQLENENNDQVHRDNLHQLKNRLPLDLRRPQALNKISGGVPDVAKSIRGLETQLDQVLKERRSHFGRLTKWAKECGITLDPLQPLIESEKQRVAERGSAHDAKELAIRLLLQRIGRLGHRLSPTNATAIQELLRPVFAVKREFNLFFHNHMGALYRSPYSTSRHQPFQINVDVAHGTDWIGTIETLIQNLFTQIQDDALLRDLVQLEGFVFSHKLRALPGVIPSELARPNNLQQMGLPALLLVLLQADQVHRETVLRVFNLYGSAINGYLFQALRPGFIVRAGFQRLETKKLRYVPKAQSWQYPDRLHHAKSAIKNSLSAGWIKKNHQGAILPQKTLTALVKQKSLKDTGVPEYLVQAPHDWYVPIDLRGPAIPIEGLTVGTEGPELTQLGPMKDDCAFRAIGPSSFKSKIDAGLLPQDVKYGDMTLIFDQHYQQSISFANGTFSIQYQPTSLQVKAAIPVVDKRPRDTRNNSHLYDRIVAIDLGERKIGYAIFDLKQVLKSEQLEPMREDGKPLIGSISIRSIRGLMKAVQTHRNRRQPNYRIDQTYSKALMHYRESVIGDVCNAIDTLCARYGGFPVLESSVRNFEVGSAQLKTVYGSVSRRYTWSAVDAHKNQRQQYWLGGTKDKIPIWTHPYLMTREWDEKNSKWSNRSKPLKMHPGVEVHPAGTSQICHQCKRNPIGALWNVADTVVLDDQGQLDLDDGTIRLNSGYIDTTEIKRARRKKIRLPENKPLTGSHKTSHVRAVARRNLRQPPKSTRAKDTTQSRYTCLYVDCGHECHADENAAINIGRKYLQERIHIEASRQALSTR

SEQ ID NO: 1123 - protein, 1269 aa, unknown
  synthetic sequence
MVAGLKKIKRDGVTMKSNYHGGVKARAWRKRIGGLARRQKETVFTYKFPLETEEAGIDFDKAVQTYGIAEGISQGSLIGLVCAFHLSGFRLFSKADETKAFCNQGRYPNQAFAEKLRNELSVTLPKLSPQSLDVLFQSSPKSKNGVAPEWSKNAIRNRLYTNWTGKGAGTNPDEHLLEIAEDIAAEIDSDLDGWKDLEEHPEKGLSAADRYFQAQGDFPSLTGLPPSVPLTPQNSTVAFEGDPVCLNPSDNTLLHQAVARCAGRILQEQPNLSPDKNRFINQLQDELVSSQNNGLSWLFGVGFKYWKEMSVDQLADDYKVKSTDLDALKQVKSFIDAIPLNPLFDTPHYGEFRASVAGKMRSWVKNYWKRLLDLKSQLGTANINLPEGLDEQRAENLFSGLLIDSKGLRQVTDKLPSRLKKAEDTIDRLMGDGNPTSDDIEQVETVAAEISAFIGQVEQFNNQLEQRLENPLEGDDETFLKQLKIDLPAEFKKPPAINRISGGSPDPTAEIAELEEKLDRLMSARKEHYETIAEWASANKVTLDPMEAMTTLEAQRLTERGAEGDQEEFALRLLLQRIGRLANRLSPQGATAIRDLLRPVFTEKREFNLFFHNRMGSLYRSPYSTSRHQPFTIDVAVAKNTDWMDALDGIAETIMKGLSQAGDELSLRLRDWINISGFSLSQRLRGLPDTVPGELALVRSADDVRIPPMLALQLEEDEVSREVCLKAFNLYVSAINGCLFRALREGFIVRTKFQRLERDVLSYVPKTKLWNYPQRLDTARGPIHSALAAAWINKEGSVIDPVETVTALSDTGFSDDGIPEYLVQAPHDWYTPIDLRDISKPVSGLPVKKNITGLKRQKKQTAFRMVGPSSFKSHLDSTLLSEEVKLGDFTLIFDQYYKQRVSYNGRVKITFEPDRLHVEAAVPVIDKRVRPSTEEDALFDHLLAIDLGEKRVGYAVYDIKACLRTGDIKPLEDGDGKPIVGSVAVPSIRRLMKAVRSHRQQRQPNQKVNQTYSTALMNYRENVIGDVCNRIDTLMEKYNAFPVLESSVMNFEAGSRQLEMVYGSVLHRYTYSKIDAHTAKRKEYWYTGEYWDHPYLMAHKWNERTRSYSGSLSALTLYPGVMVHPAGTSQRCHQCKRNPMVEIKQLTGQVEINADGSLELDDGTICLYEGYDYSPEEYKKAKREKRRLDPNVPLSGRHQAKHVSAVAKRNLRRPTVSMMSGDTTQARYVCLYTDCDFTGHADENAAINIGWKYLTERIALSESKDKAGV

SEQ ID NO: 1124 - protein, 1340 aa, unknown
  synthetic sequence
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 1125 - protein, 1437 aa, unknown
  synthetic sequence
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 1126 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 1127 - protein, 1334 aa, unknown
  synthetic sequence
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 1128 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 1129 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 1130 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 1131 - protein, 1051 aa, Listeria newyorkensis
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 1132 - protein, 1182 aa, Leptotrichia wadei
MYMKITKIDGVSHYKKQDKGILKKKWKDLDERKQREKIEARYNKQIESKIYKEFFRLKNKKRIEKEEDQNIKSLYFFIKELYLNEKNEEWELKNINLEILDDKERVIKGYKFKEDVYFFKEGYKEYYLRILFNNLIEKVQNENREKVRKNKEFLDLKEIFKKYKNRKIDLLLKSINNNKINLEYKKENVNEEIYGINPTNDREMTFYELLKEIIEKKDEQKSILEEKLDNFDITNFLENIEKIFNEETEINIIKGKVLNELREYIKEKEENNSDNKLKQIYNLELKKYIENNFSYKKQKSKSKNGKNDYLYLNFLKKIMFIEEVDEKKEINKEKFKNKINSNFKNLFVQHILDYGKLLYYKENDEYIKNTGQLETKDLEYIKTKETLIRKMAVLVSFAANSYYNLFGRVSGDILGTEVVKSSKTNVIKVGSHIFKEKMLNYFFDFEIFDANKIVEILESISYSIYNVRNGVGHFNKLILGKYKKKDINTNKRIEEDLNNNEEIKGYFIKKRGEIERKVKEKFLSNNLQYYYSKEKIENYFEVYEFEILKRKIPFAPNFKRIIKKGEDLFNNKNNKKYEYFKNFDKNSAEEKKEFLKTRNFLLKELYYNNFYKEFLSKKEEFEKIVLEVKEEKKSRGNINNKKSGVSFQSIDDYDTKINISDYIASIHKKEMERVEKYNEEKQKDTAKYIRDFVEEIFLTGFINYLEKDKRLHFLKEEFSILCNNNNNVVDFNININEEKIKEFLKENDSKTLNLYLFFNMIDSKRISEFRNELVKYKQFTKKRLDEEKEFLGIKIELYETLIEFVILTREKLDTKKSEEIDAWLVDKLYVKDSNEYKEYEEILKLFVDEKILSSKEAPYYATDNKTPILLSNFEKTRKYGTQSFLSEIQSNYKYSKVEKENIEDYNKKEEIEQKKKSNIEKLQDLKVELHKKWEQNKITEKEIEKYNNTTRKINEYNYLKNKEELQNVYLLHEMLSDLLARNVAFFNKWERDFKFIVIAIKQFLRENDKEKVNEFLNPPDNSKGKKVYFSVSKYKNTVENIDGIHKNFMNLIFLNNKFMNRKIDKMNCAIWVYFRNYIAHFLHLHTKNEKISLISQMNLLIKLFSYDKKVQNHILKSTKTLLEKYNIQINFEISNDKNEVFKYKIKNRLYSKKGKMLGKNNKFEILENEFLENVKAMLEYSE

SEQ ID NO: 1133 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 1134 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 1135 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 1136 - DNA, 20 bp, Artificial Sequence
  synthetic sequence
ctctgcattgttttggcctc

SEQ ID NO: 1137 - DNA, 20 bp, Artificial Sequence
  synthetic sequence
tcctccaaagagtagaatgg

SEQ ID NO: 1138 - DNA, 20 bp, Artificial Sequence
  synthetic sequence
gccctaaacttacactgttc

SEQ ID NO: 1139 - DNA, 20 bp, Artificial Sequence
  synthetic sequence
aaagatagattagattgtcc

SEQ ID NO: 1140 - DNA, 20 bp, Artificial Sequence
  synthetic sequence
gtggtgtcctttgaatatgc

SEQ ID NO: 1141 - DNA, 20 bp, Artificial Sequence
  synthetic sequence
agattgtccaggatataatt

SEQ ID NO: 1142 - DNA, 20 bp, Artificial Sequence
  synthetic sequence
ttagcaaccaaattatatcc

SEQ ID NO: 1143 - DNA, 20 bp, Artificial Sequence
  synthetic sequence
gttgaaattaaactacacac

SEQ ID NO: 1144 - DNA, 20 bp, Artificial Sequence
  synthetic sequence
atctttacctgcatattcaa

SEQ ID NO: 1145 - DNA, 17 bp, Artificial Sequence
  synthetic sequence
gtgtcctttgaatatgc

SEQ ID NO: 1146 - DNA, 17 bp, Artificial Sequence
  synthetic sequence
ttgtccaggatataatt

SEQ ID NO: 1147 - DNA, 17 bp, Artificial Sequence
  synthetic sequence
gcaaccaaattatatcc

SEQ ID NO: 1148 - DNA, 17 bp, Artificial Sequence
  synthetic sequence
gaaattaaactacacac

SEQ ID NO: 1149 - DNA, 17 bp, Artificial Sequence
  synthetic sequence
tttacctgcatattcaa

SEQ ID NO: 1150 - RNA, 20 nt, Artificial Sequence
  synthetic sequence
gugguguccuuugaauaugc

SEQ ID NO: 1151 - RNA, 20 nt, Artificial Sequence
  synthetic sequence
agauuguccaggauauaauu

SEQ ID NO: 1152 - RNA, 20 nt, Artificial Sequence
  synthetic sequence
uuagcaaccaaauuauaucc

SEQ ID NO: 1153 - RNA, 20 nt, Artificial Sequence
  synthetic sequence
guugaaauuaaacuacacac

SEQ ID NO: 1154 - RNA, 20 nt, Artificial Sequence
  synthetic sequence
aucuuuaccugcauauucaa

SEQ ID NO: 1155 - RNA, 17 nt, Artificial Sequence
  synthetic sequence
guguccuuugaauaugc

SEQ ID NO: 1156 - RNA, 17 nt, Artificial Sequence
  synthetic sequence
uuguccaggauauaauu

SEQ ID NO: 1157 - RNA, 17 nt, Artificial Sequence
  synthetic sequence
gcaaccaaauuauaucc

SEQ ID NO: 1158 - RNA, 17 nt, Artificial Sequence
  synthetic sequence
gaaauuaaacuacacac

SEQ ID NO: 1159 - RNA, 17 nt, Artificial Sequence
  synthetic sequence
uuuaccugcauauucaa

SEQ ID NO: 1160 - DNA, 20 bp, Artificial Sequence
  synthetic sequence
tacacatttttaggcttgac

SEQ ID NO: 1161 - DNA, 20 bp, Artificial Sequence
  synthetic sequence
cattcctgggagtctgtcat

SEQ ID NO: 1162 - DNA, 20 bp, Artificial Sequence
  synthetic sequence
tgtatgatgctataatacca

SEQ ID NO: 1163 - DNA, 20 bp, Artificial Sequence
  synthetic sequence
gtggaaagtacataggacct

SEQ ID NO: 1164 - DNA, 20 bp, Artificial Sequence
  synthetic sequence
tcttatcataactcttacca

SEQ ID NO: 1165 - DNA, 17 bp, Artificial Sequence
  synthetic sequence
acatttttaggcttgac

SEQ ID NO: 1166 - DNA, 17 bp, Artificial Sequence
  synthetic sequence
tcctgggagtctgtcat

SEQ ID NO: 1167 - DNA, 17 bp, Artificial Sequence
  synthetic sequence
atgatgctataatacca

SEQ ID NO: 1168 - DNA, 17 bp, Artificial Sequence
  synthetic sequence
gaaagtacataggacct

SEQ ID NO: 1169 - DNA, 17 bp, Artificial Sequence
  synthetic sequence
tatcataactcttacca

SEQ ID NO: 1170 - RNA, 20 nt, Artificial Sequence
  synthetic sequence
uacacauuuuuaggcuugac

SEQ ID NO: 1171 - RNA, 20 nt, Artificial Sequence
  synthetic sequence
cauuccugggagucugucau

SEQ ID NO: 1172 - RNA, 20 nt, Artificial Sequence
  synthetic sequence
uguaugaugcuauaauacca

SEQ ID NO: 1173 - RNA, 20 nt, Artificial Sequence
  synthetic sequence
guggaaaguacauaggaccu

SEQ ID NO: 1174 - RNA, 20 nt, Artificial Sequence
  synthetic sequence
ucuuaucauaacucuuacca

SEQ ID NO: 1175 - RNA, 17 nt, Artificial Sequence
  synthetic sequence
acauuuuuaggcuugac

SEQ ID NO: 1176 - RNA, 17 nt, Artificial Sequence
  synthetic sequence
uccugggagucugucau

SEQ ID NO: 1177 - RNA, 17 nt, Artificial Sequence
  synthetic sequence
augaugcuauaauacca

SEQ ID NO: 1178 - RNA, 17 nt, Artificial Sequence
  synthetic sequence
gaaaguacauaggaccu

SEQ ID NO: 1179 - RNA, 17 nt, Artificial Sequence
  synthetic sequence
uaucauaacucuuacca

SEQ ID NO: 1180 - DNA, 20 bp, Artificial Sequence
  synthetic sequence
gttgctaaattacatagttt

SEQ ID NO: 1181 - DNA, 20 bp, Artificial Sequence
  synthetic sequence
tgttgcaatagtcaatcaag

SEQ ID NO: 1182 - DNA, 20 bp, Artificial Sequence
  synthetic sequence
atactgattaagacagatga

SEQ ID NO: 1183 - DNA, 20 bp, Artificial Sequence
  synthetic sequence
aatactgattaagacagatg

SEQ ID NO: 1184 - DNA, 20 bp, Artificial Sequence
  synthetic sequence
ctctatacaaatgccaacgc

SEQ ID NO: 1185 - DNA, 20 bp, Artificial Sequence
  synthetic sequence
acttgcatgcacaccagcgt

SEQ ID NO: 1186 - DNA, 20 bp, Artificial Sequence
  synthetic sequence
ttgggctaatgtagcataat

SEQ ID NO: 1187 - DNA, 20 bp, Artificial Sequence
  synthetic sequence
gcgttggcatttgtatagag

SEQ ID NO: 1188 - DNA, 20 bp, Artificial Sequence
  synthetic sequence
tgggctaatgtagcataatg

SEQ ID NO: 1189 - DNA, 20 bp, Artificial Sequence
  synthetic sequence
tttgggctaatgtagcataa

SEQ ID NO: 1190 - DNA, 20 bp, Artificial Sequence
  synthetic sequence
gcttaactccttaatattaa

SEQ ID NO: 1191 - DNA, 20 bp, Artificial Sequence
  synthetic sequence
tcttctatattaaagcagat

SEQ ID NO: 1192 - DNA, 20 bp, Artificial Sequence
  synthetic sequence
cttctatattaaagcagatt

SEQ ID NO: 1193 - DNA, 20 bp, Artificial Sequence
  synthetic sequence
aatatataactaccttgggt

SEQ ID NO: 1194 - DNA, 20 bp, Artificial Sequence
  synthetic sequence
acctccattctactctttgg

SEQ ID NO: 1195 - DNA, 20 bp, Artificial Sequence
  synthetic sequence
tttcaatgatatccaaccca

SEQ ID NO: 1196 - DNA, 20 bp, Artificial Sequence
  synthetic sequence
agtacctccattctactctt

SEQ ID NO: 1197 - DNA, 20 bp, Artificial Sequence
  synthetic sequence
ctatcctccaaagagtagaa

SEQ ID NO: 1198 - DNA, 20 bp, Artificial Sequence
  synthetic sequence
ttttgctacatatttcaggc

SEQ ID NO: 1199 - DNA, 20 bp, Artificial Sequence
  synthetic sequence
tttgctacatatttcaggct

SEQ ID NO: 1200 - DNA, 20 bp, Artificial Sequence
  synthetic sequence
gggttggatatcattgaaaa

SEQ ID NO: 1201 - DNA, 20 bp, Artificial Sequence
  synthetic sequence
atatttcaggctgggtttct

SEQ ID NO: 1202 - DNA, 20 bp, Artificial Sequence
  synthetic sequence
ttgaaatatataactacctt

SEQ ID NO: 1203 - DNA, 20 bp, Artificial Sequence
  synthetic sequence
attgaaatatataactacct

SEQ ID NO: 1204 - DNA, 20 bp, Artificial Sequence
  synthetic sequence
gtgagtagtggggcacttta

SEQ ID NO: 1205 - DNA, 20 bp, Artificial Sequence
  synthetic sequence
tgtatgtagaaggttaacta

SEQ ID NO: 1206 - DNA, 20 bp, Artificial Sequence
  synthetic sequence
gagcctaataaatgtacaat

SEQ ID NO: 1207 - DNA, 20 bp, Artificial Sequence
  synthetic sequence
ttgtatgtagaaggttaact

SEQ ID NO: 1208 - DNA, 20 bp, Artificial Sequence
  synthetic sequence
caatttgttttgatgtaact

SEQ ID NO: 1209 - DNA, 20 bp, Artificial Sequence
  synthetic sequence
tgccttctgaaatagtccag

SEQ ID NO: 1210 - DNA, 20 bp, Artificial Sequence
  synthetic sequence
gttaatagggaaacagcata

SEQ ID NO: 1211 - DNA, 20 bp, Artificial Sequence
  synthetic sequence
aacaatgcagagttaattgt

SEQ ID NO: 1212 - DNA, 20 bp, Artificial Sequence
  synthetic sequence
gaacatgttgagtagacaca

SEQ ID NO: 1213 - DNA, 20 bp, Artificial Sequence
  synthetic sequence
tttatcatctgtgtctattc

SEQ ID NO: 1214 - DNA, 20 bp, Artificial Sequence
  synthetic sequence
tctttactttcttgactata

SEQ ID NO: 1215 - DNA, 20 bp, Artificial Sequence
  synthetic sequence
aatattctcaaacctcgttc

SEQ ID NO: 1216 - DNA, 20 bp, Artificial Sequence
  synthetic sequence
attaactgtgttccagaacg

SEQ ID NO: 1217 - DNA, 20 bp, Artificial Sequence
  synthetic sequence
taactgcttctttggatgac

SEQ ID NO: 1218 - DNA, 20 bp, Artificial Sequence
  synthetic sequence
gaccagaacagtgtaagttt

SEQ ID NO: 1219 - DNA, 20 bp, Artificial Sequence
  synthetic sequence
accagaacagtgtaagttta

SEQ ID NO: 1220 - DNA, 20 bp, Artificial Sequence
  synthetic sequence
ctactttttccccactactg

SEQ ID NO: 1221 - DNA, 20 bp, Artificial Sequence
  synthetic sequence
tggaacacagttaattcact

SEQ ID NO: 1222 - DNA, 20 bp, Artificial Sequence
  synthetic sequence
gtgttgtttaactgcttctt

SEQ ID NO: 1223 - RNA, 20 nt, Artificial Sequence
  synthetic sequence
cucugcauuguuuuggccuc

SEQ ID NO: 1224 - RNA, 20 nt, Artificial Sequence
  synthetic sequence
uccuccaaagaguagaaugg

SEQ ID NO: 1225 - RNA, 20 nt, Artificial Sequence
  synthetic sequence
gcccuaaacuuacacuguuc

SEQ ID NO: 1226 - RNA, 20 nt, Artificial Sequence
  synthetic sequence
aaagauagauuagauugucc

SEQ ID NO: 1227 - RNA, 20 nt, Artificial Sequence
  synthetic sequence
guugcuaaauuacauaguuu

SEQ ID NO: 1228 - RNA, 20 nt, Artificial Sequence
  synthetic sequence
uguugcaauagucaaucaag

SEQ ID NO: 1229 - RNA, 20 nt, Artificial Sequence
  synthetic sequence
auacugauuaagacagauga

SEQ ID NO: 1230 - RNA, 20 nt, Artificial Sequence
  synthetic sequence
aauacugauuaagacagaug

SEQ ID NO: 1231 - RNA, 20 nt, Artificial Sequence
  synthetic sequence
cucuauacaaaugccaacgc

SEQ ID NO: 1232 - RNA, 20 nt, Artificial Sequence
  synthetic sequence
acuugcaugcacaccagcgu

SEQ ID NO: 1233 - RNA, 20 nt, Artificial Sequence
  synthetic sequence
uugggcuaauguagcauaau

SEQ ID NO: 1234 - RNA, 20 nt, Artificial Sequence
  synthetic sequence
gcguuggcauuuguauagag

SEQ ID NO: 1235 - RNA, 19 nt, Artificial Sequence
  synthetic sequence
ugggcuaaguagcauaaug

SEQ ID NO: 1236 - RNA, 20 nt, Artificial Sequence
  synthetic sequence
uuugggcuaauguagcauaa

SEQ ID NO: 1237 - RNA, 20 nt, Artificial Sequence
  synthetic sequence
gcuuaacuccuuaauauuaa

SEQ ID NO: 1238 - RNA, 20 nt, Artificial Sequence
  synthetic sequence
ucuucuauauuaaagcagau

SEQ ID NO: 1239 - RNA, 20 nt, Artificial Sequence
  synthetic sequence
cuucuauauuaaagcagauu

SEQ ID NO: 1240 - RNA, 20 nt, Artificial Sequence
  synthetic sequence
aauauauaacuaccuugggu

SEQ ID NO: 1241 - RNA, 20 nt, Artificial Sequence
  synthetic sequence
accuccauucuacucuuugg

SEQ ID NO: 1242 - RNA, 20 nt, Artificial Sequence
  synthetic sequence
uuucaaugauauccaaccca

SEQ ID NO: 1243 - RNA, 20 nt, Artificial Sequence
  synthetic sequence
aguaccuccauucuacucuu

SEQ ID NO: 1244 - RNA, 20 nt, Artificial Sequence
  synthetic sequence
cuauccuccaaagaguagaa

SEQ ID NO: 1245 - RNA, 20 nt, Artificial Sequence
  synthetic sequence
uuuugcuacauauuucaggc

SEQ ID NO: 1246 - RNA, 20 nt, Artificial Sequence
  synthetic sequence
uuugcuacauauuucaggcu

SEQ ID NO: 1247 - RNA, 20 nt, Artificial Sequence
  synthetic sequence
ggguuggauaucauugaaaa

SEQ ID NO: 1248 - RNA, 19 nt, Artificial Sequence
  synthetic sequence
auauuucaggcuggguucu

SEQ ID NO: 1249 - RNA, 20 nt, Artificial Sequence
  synthetic sequence
uugaaauauauaacuaccuu

SEQ ID NO: 1250 - RNA, 20 nt, Artificial Sequence
  synthetic sequence
auugaaauauauaacuaccu

SEQ ID NO: 1251 - RNA, 20 nt, Artificial Sequence
  synthetic sequence
gugaguaguggggcacuuua

SEQ ID NO: 1252 - RNA, 20 nt, Artificial Sequence
  synthetic sequence
uguauguagaagguuaacua

SEQ ID NO: 1253 - RNA, 20 nt, Artificial Sequence
  synthetic sequence
gagccuaauaaauguacaau

SEQ ID NO: 1254 - RNA, 20 nt, Artificial Sequence
  synthetic sequence
uuguauguagaagguuaacu

SEQ ID NO: 1255 - RNA, 19 nt, Artificial Sequence
  synthetic sequence
caauuuguuuugaguaacu

SEQ ID NO: 1256 - RNA, 20 nt, Artificial Sequence
  synthetic sequence
ugccuucugaaauaguccag

SEQ ID NO: 1257 - RNA, 20 nt, Artificial Sequence
  synthetic sequence
guuaauagggaaacagcaua

SEQ ID NO: 1258 - RNA, 20 nt, Artificial Sequence
  synthetic sequence
aacaaugcagaguuaauugu

SEQ ID NO: 1259 - RNA, 20 nt, Artificial Sequence
  synthetic sequence
gaacauguugaguagacaca

SEQ ID NO: 1260 - RNA, 20 nt, Artificial Sequence
  synthetic sequence
uuuaucaucugugucuauuc

SEQ ID NO: 1261 - RNA, 20 nt, Artificial Sequence
  synthetic sequence
ucuuuacuuucuugacuaua

SEQ ID NO: 1262 - RNA, 20 nt, Artificial Sequence
  synthetic sequence
aauauucucaaaccucguuc

SEQ ID NO: 1263 - RNA, 20 nt, Artificial Sequence
  synthetic sequence
auuaacuguguuccagaacg

SEQ ID NO: 1264 - RNA, 20 nt, Artificial Sequence
  synthetic sequence
uaacugcuucuuuggaugac

SEQ ID NO: 1265 - RNA, 20 nt, Artificial Sequence
  synthetic sequence
gaccagaacaguguaaguuu

SEQ ID NO: 1266 - RNA, 20 nt, Artificial Sequence
  synthetic sequence
accagaacaguguaaguuua

SEQ ID NO: 1267 - RNA, 20 nt, Artificial Sequence
  synthetic sequence
cuacuuuuuccccacuacug

SEQ ID NO: 1268 - RNA, 20 nt, Artificial Sequence
  synthetic sequence
uggaacacaguuaauucacu

SEQ ID NO: 1269 - RNA, 20 nt, Artificial Sequence
  synthetic sequence
guguuguuuaacugcuucuu

SEQ ID NO: 1270 - DNA, 20 bp, Artificial Sequence
  synthetic sequence
aactgtcagttgcatattcc

SEQ ID NO: 1271 - DNA, 20 bp, Artificial Sequence
  synthetic sequence
cagaaaggaatgctggtacc

SEQ ID NO: 1272 - DNA, 20 bp, Artificial Sequence
  synthetic sequence
tctgcctacacaatgaatgg

SEQ ID NO: 1273 - DNA, 20 bp, Artificial Sequence
  synthetic sequence
cacagatcaatccaattgtt

SEQ ID NO: 1274 - DNA, 20 bp, Artificial Sequence
  synthetic sequence
ttgacaggtggaaagtacat

SEQ ID NO: 1275 - DNA, 20 bp, Artificial Sequence
  synthetic sequence
acatttttaggcttgacagg

SEQ ID NO: 1276 - DNA, 20 bp, Artificial Sequence
  synthetic sequence
ctctcccatgacagactccc

SEQ ID NO: 1277 - DNA, 20 bp, Artificial Sequence
  synthetic sequence
ttggtaagagttatgataag

SEQ ID NO: 1278 - DNA, 20 bp, Artificial Sequence
  synthetic sequence
aacacaaattaagttcacct

SEQ ID NO: 1279 - DNA, 20 bp, Artificial Sequence
  synthetic sequence
aggatcagtgctgtagtgcc

SEQ ID NO: 1280 - DNA, 20 bp, Artificial Sequence
  synthetic sequence
ggccgtttattattattgac

SEQ ID NO: 1281 - DNA, 20 bp, Artificial Sequence
  synthetic sequence
tctcaggattgctatgcaac

SEQ ID NO: 1282 - DNA, 20 bp, Artificial Sequence
  synthetic sequence
caggaagacataccatgtaa

SEQ ID NO: 1283 - DNA, 20 bp, Artificial Sequence
  synthetic sequence
agcagggctctttcagtttc

SEQ ID NO: 1284 - DNA, 20 bp, Artificial Sequence
  synthetic sequence
taacattttcagcttgaacc

SEQ ID NO: 1285 - DNA, 20 bp, Artificial Sequence
  synthetic sequence
tcaagctgaaaatgttacac

SEQ ID NO: 1286 - DNA, 20 bp, Artificial Sequence
  synthetic sequence
gtaacattttcagcttgaac

SEQ ID NO: 1287 - DNA, 20 bp, Artificial Sequence
  synthetic sequence
cagaatgaattttggagcac

SEQ ID NO: 1288 - DNA, 20 bp, Artificial Sequence
  synthetic sequence
tttattattattgactggtg

SEQ ID NO: 1289 - DNA, 20 bp, Artificial Sequence
  synthetic sequence
agaagaatctgacctttaca

SEQ ID NO: 1290 - DNA, 20 bp, Artificial Sequence
  synthetic sequence
gcagggctctttcagtttct

SEQ ID NO: 1291 - DNA, 20 bp, Artificial Sequence
  synthetic sequence
ctaaacagtagccaggcgtg

SEQ ID NO: 1292 - DNA, 20 bp, Artificial Sequence
  synthetic sequence
cgcctggctactgtttagtg

SEQ ID NO: 1293 - DNA, 20 bp, Artificial Sequence
  synthetic sequence
ctccgcactaaacagtagcc

SEQ ID NO: 1294 - DNA, 20 bp, Artificial Sequence
  synthetic sequence
gtagccaggcgtgtggatgt

SEQ ID NO: 1295 - DNA, 20 bp, Artificial Sequence
  synthetic sequence
cttggctttgactattctgc

SEQ ID NO: 1296 - DNA, 20 bp, Artificial Sequence
  synthetic sequence
agtagccaggcgtgtggatg

SEQ ID NO: 1297 - DNA, 20 bp, Artificial Sequence
  synthetic sequence
tcctcccacatccacacgcc

SEQ ID NO: 1298 - DNA, 20 bp, Artificial Sequence
  synthetic sequence
ttggctttgactattctgct

SEQ ID NO: 1299 - DNA, 20 bp, Artificial Sequence
  synthetic sequence
ataatgtctctggcttgtaa

SEQ ID NO: 1300 - DNA, 20 bp, Artificial Sequence
  synthetic sequence
tggtacccggcagctctctg

SEQ ID NO: 1301 - DNA, 20 bp, Artificial Sequence
  synthetic sequence
gtgggaggaacctcaaagag

SEQ ID NO: 1302 - DNA, 20 bp, Artificial Sequence
  synthetic sequence
tgactattctgctgggaaca

SEQ ID NO: 1303 - DNA, 20 bp, Artificial Sequence
  synthetic sequence
ctctctgaggaatgttccct

SEQ ID NO: 1304 - DNA, 20 bp, Artificial Sequence
  synthetic sequence
aacattcctcagagagctgc

SEQ ID NO: 1305 - DNA, 20 bp, Artificial Sequence
  synthetic sequence
attctgaagctccaaacaat

SEQ ID NO: 1306 - DNA, 20 bp, Artificial Sequence
  synthetic sequence
taaattactctgctaaagta

SEQ ID NO: 1307 - DNA, 20 bp, Artificial Sequence
  synthetic sequence
agtacaaaccaggtttgtac

SEQ ID NO: 1308 - DNA, 20 bp, Artificial Sequence
  synthetic sequence
atatccttccagtacaaacc

SEQ ID NO: 1309 - DNA, 20 bp, Artificial Sequence
  synthetic sequence
caaaccaggtttgtactgga

SEQ ID NO: 1310 - DNA, 20 bp, Artificial Sequence
  synthetic sequence
ggcagctaaagcatcactga

SEQ ID NO: 1311 - DNA, 20 bp, Artificial Sequence
  synthetic sequence
atctctgagtagtacaaacc

SEQ ID NO: 1312 - DNA, 20 bp, Artificial Sequence
  synthetic sequence
gtgtcccattctctttgact

SEQ ID NO: 1313 - DNA, 20 bp, Artificial Sequence
  synthetic sequence
tgtgtcccattctctttgac

SEQ ID NO: 1314 - DNA, 20 bp, Artificial Sequence
  synthetic sequence
ttctgaatgttgaacaagta

SEQ ID NO: 1315 - DNA, 20 bp, Artificial Sequence
  synthetic sequence
gtctcccagtcaaagagaat

SEQ ID NO: 1316 - DNA, 20 bp, Artificial Sequence
  synthetic sequence
attctctttgactgggagac

SEQ ID NO: 1317 - DNA, 20 bp, Artificial Sequence
  synthetic sequence
tctttgactgggagacaggc

SEQ ID NO: 1318 - RNA, 20 nt, Artificial Sequence
  synthetic sequence
aacugucaguugcauauucc

SEQ ID NO: 1319 - RNA, 20 nt, Artificial Sequence
  synthetic sequence
cagaaaggaaugcugguacc

SEQ ID NO: 1320 - RNA, 20 nt, Artificial Sequence
  synthetic sequence
ucugccuacacaaugaaugg

SEQ ID NO: 1321 - RNA, 20 nt, Artificial Sequence
  synthetic sequence
cacagaucaauccaauuguu

SEQ ID NO: 1322 - RNA, 20 nt, Artificial Sequence
  synthetic sequence
uugacagguggaaaguacau

SEQ ID NO: 1323 - RNA, 20 nt, Artificial Sequence
  synthetic sequence
acauuuuuaggcuugacagg

SEQ ID NO: 1324 - RNA, 20 nt, Artificial Sequence
  synthetic sequence
cucucccaugacagacuccc

SEQ ID NO: 1325 - RNA, 20 nt, Artificial Sequence
  synthetic sequence
uugguaagaguuaugauaag

SEQ ID NO: 1326 - RNA, 20 nt, Artificial Sequence
  synthetic sequence
aacacaaauuaaguucaccu

SEQ ID NO: 1327 - RNA, 20 nt, Artificial Sequence
  synthetic sequence
aggaucagugcuguagugcc

SEQ ID NO: 1328 - RNA, 20 nt, Artificial Sequence
  synthetic sequence
ggccguuuauuauuauugac

SEQ ID NO: 1329 - RNA, 20 nt, Artificial Sequence
  synthetic sequence
ucucaggauugcuaugcaac

SEQ ID NO: 1330 - RNA, 20 nt, Artificial Sequence
  synthetic sequence
caggaagacauaccauguaa

SEQ ID NO: 1331 - RNA, 20 nt, Artificial Sequence
  synthetic sequence
agcagggcucuuucaguuuc

SEQ ID NO: 1332 - RNA, 20 nt, Artificial Sequence
  synthetic sequence
uaacauuuucagcuugaacc

SEQ ID NO: 1333 - RNA, 20 nt, Artificial Sequence
  synthetic sequence
ucaagcugaaaauguuacac

SEQ ID NO: 1334 - RNA, 20 nt, Artificial Sequence
  synthetic sequence
guaacauuuucagcuugaac

SEQ ID NO: 1335 - RNA, 20 nt, Artificial Sequence
  synthetic sequence
cagaaugaauuuuggagcac

SEQ ID NO: 1336 - RNA, 20 nt, Artificial Sequence
  synthetic sequence
uuuauuauuauugacuggug

SEQ ID NO: 1337 - RNA, 20 nt, Artificial Sequence
  synthetic sequence
agaagaaucugaccuuuaca

SEQ ID NO: 1338 - RNA, 20 nt, Artificial Sequence
  synthetic sequence
gcagggcucuuucaguuucu

SEQ ID NO: 1339 - RNA, 20 nt, Artificial Sequence
  synthetic sequence
cuaaacaguagccaggcgug

SEQ ID NO: 1340 - RNA, 20 nt, Artificial Sequence
  synthetic sequence
cgccuggcuacuguuuagug

SEQ ID NO: 1341 - RNA, 20 nt, Artificial Sequence
  synthetic sequence
cuccgcacuaaacaguagcc

SEQ ID NO: 1342 - RNA, 20 nt, Artificial Sequence
  synthetic sequence
guagccaggcguguggaugu

SEQ ID NO: 1343 - RNA, 20 nt, Artificial Sequence
  synthetic sequence
cuuggcuuugacuauucugc

SEQ ID NO: 1344 - RNA, 20 nt, Artificial Sequence
  synthetic sequence
aguagccaggcguguggaug

SEQ ID NO: 1345 - RNA, 20 nt, Artificial Sequence
  synthetic sequence
uccucccacauccacacgcc

SEQ ID NO: 1346 - RNA, 20 nt, Artificial Sequence
  synthetic sequence
uuggcuuugacuauucugcu

SEQ ID NO: 1347 - RNA, 20 nt, Artificial Sequence
  synthetic sequence
auaaugucucuggcuuguaa

SEQ ID NO: 1348 - RNA, 20 nt, Artificial Sequence
  synthetic sequence
ugguacccggcagcucucug

SEQ ID NO: 1349 - RNA, 20 nt, Artificial Sequence
  synthetic sequence
gugggaggaaccucaaagag

SEQ ID NO: 1350 - RNA, 20 nt, Artificial Sequence
  synthetic sequence
ugacuauucugcugggaaca

SEQ ID NO: 1351 - RNA, 20 nt, Artificial Sequence
  synthetic sequence
cucucugaggaauguucccu

SEQ ID NO: 1352 - RNA, 20 nt, Artificial Sequence
  synthetic sequence
aacauuccucagagagcugc

SEQ ID NO: 1353 - RNA, 20 nt, Artificial Sequence
  synthetic sequence
auucugaagcuccaaacaau

SEQ ID NO: 1354 - RNA, 20 nt, Artificial Sequence
  synthetic sequence
uaaauuacucugcuaaagua

SEQ ID NO: 1355 - RNA, 20 nt, Artificial Sequence
  synthetic sequence
aguacaaaccagguuuguac

SEQ ID NO: 1356 - RNA, 20 nt, Artificial Sequence
  synthetic sequence
auauccuuccaguacaaacc

SEQ ID NO: 1357 - RNA, 20 nt, Artificial Sequence
  synthetic sequence
caaaccagguuuguacugga

SEQ ID NO: 1358 - RNA, 20 nt, Artificial Sequence
  synthetic sequence
ggcagcuaaagcaucacuga

SEQ ID NO: 1359 - RNA, 20 nt, Artificial Sequence
  synthetic sequence
aucucugaguaguacaaacc

SEQ ID NO: 1360 - RNA, 20 nt, Artificial Sequence
  synthetic sequence
gugucccauucucuuugacu

SEQ ID NO: 1361 - RNA, 20 nt, Artificial Sequence
  synthetic sequence
ugugucccauucucuuugac

SEQ ID NO: 1362 - RNA, 20 nt, Artificial Sequence
  synthetic sequence
uucugaauguugaacaagua

SEQ ID NO: 1363 - RNA, 20 nt, Artificial Sequence
  synthetic sequence
gucucccagucaaagagaau

SEQ ID NO: 1364 - RNA, 20 nt, Artificial Sequence
  synthetic sequence
auucucuuugacugggagac

SEQ ID NO: 1365 - RNA, 20 nt, Artificial Sequence
  synthetic sequence
ucuuugacugggagacaggc

SEQ ID NO: 1366 - DNA, 82 bp, Artificial Sequence
  synthetic sequence
gttttagagctagaaatagcaagttaaaataaggctagtccgttatcaacttgaaaaagtggcaccgagtcggtgctttttt

SEQ ID NO: 1367 - RNA, 82 nt, Artificial Sequence
  synthetic sequence
guuuuagagcuagaaauagcaaguuaaaauaaggcuaguccguuaucaacuugaaaaaguggcaccgagucggugcuuuuuu

SEQ ID NO: 1368 - DNA, 23 bp, Artificial Sequence
  synthetic sequence
gtggtgtcctttgaatatgcagg

SEQ ID NO: 1369 - DNA, 23 bp, Artificial Sequence
  synthetic sequence
agattgtccaggatataatttgg

SEQ ID NO: 1370 - DNA, 23 bp, Artificial Sequence
  synthetic sequence
ttagcaaccaaattatatcctgg

SEQ ID NO: 1371 - DNA, 23 bp, Artificial Sequence
  synthetic sequence
gttgaaattaaactacacactgg

SEQ ID NO: 1372 - DNA, 23 bp, Artificial Sequence
  synthetic sequence
atctttacctgcatattcaaagg

SEQ ID NO: 1373 - DNA, 23 bp, Artificial Sequence
  synthetic sequence
tacacatttttaggcttgacagg

SEQ ID NO: 1374 - DNA, 23 bp, Artificial Sequence
  synthetic sequence
cattcctgggagtctgtcatggg

SEQ ID NO: 1375 - DNA, 23 bp, Artificial Sequence
  synthetic sequence
tgtatgatgctataataccaagg

SEQ ID NO: 1376 - DNA, 23 bp, Artificial Sequence
  synthetic sequence
gtggaaagtacataggaccttgg

SEQ ID NO: 1377 - DNA, 23 bp, Artificial Sequence
  synthetic sequence
tcttatcataactcttaccaagg

SEQ ID NO: 1378 - DNA, 24 bp, Artificial Sequence
  synthetic sequence
caccgtggtgtcctttgaatatgc

SEQ ID NO: 1379 - DNA, 25 bp, Artificial Sequence
  synthetic sequence
caccgagattgtccaggatataatt

SEQ ID NO: 1380 - DNA, 25 bp, Artificial Sequence
  synthetic sequence
caccgttagcaaccaaattatatcc

SEQ ID NO: 1381 - DNA, 24 bp, Artificial Sequence
  synthetic sequence
caccgttgaaattaaactacacac

SEQ ID NO: 1382 - DNA, 25 bp, Artificial Sequence
  synthetic sequence
caccgatctttacctgcatattcaa

SEQ ID NO: 1383 - DNA, 25 bp, Artificial Sequence
  synthetic sequence
caccgtacacatttttaggcttgac

SEQ ID NO: 1384 - DNA, 25 bp, Artificial Sequence
  synthetic sequence
caccgcattcctgggagtctgtcat

SEQ ID NO: 1385 - DNA, 25 bp, Artificial Sequence
  synthetic sequence
caccgtgtatgatgctataatacca

SEQ ID NO: 1386 - DNA, 24 bp, Artificial Sequence
  synthetic sequence
caccgtggaaagtacataggacct

SEQ ID NO: 1387 - DNA, 25 bp, Artificial Sequence
  synthetic sequence
caccgtcttatcataactcttacca

SEQ ID NO: 1388 - DNA, 24 bp, Artificial Sequence
  synthetic sequence
aaacgcatattcaaaggacaccac

SEQ ID NO: 1389 - DNA, 25 bp, Artificial Sequence
  synthetic sequence
aaacaattatatcctggacaatctc

SEQ ID NO: 1390 - DNA, 25 bp, Artificial Sequence
  synthetic sequence
aaacggatataatttggttgctaac

SEQ ID NO: 1391 - DNA, 24 bp, Artificial Sequence
  synthetic sequence
aaacgtgtgtagtttaatttcaac

SEQ ID NO: 1392 - DNA, 25 bp, Artificial Sequence
  synthetic sequence
aaacttgaatatgcaggtaaagatc

SEQ ID NO: 1393 - DNA, 25 bp, Artificial Sequence
  synthetic sequence
aaacgtcaagcctaaaaatgtgtac

SEQ ID NO: 1394 - DNA, 25 bp, Artificial Sequence
  synthetic sequence
aaacatgacagactcccaggaatgc

SEQ ID NO: 1395 - DNA, 25 bp, Artificial Sequence
  synthetic sequence
aaactggtattatagcatcatacac

SEQ ID NO: 1396 - DNA, 24 bp, Artificial Sequence
  synthetic sequence
aaacaggtcctatgtactttccac

SEQ ID NO: 1397 - DNA, 25 bp, Artificial Sequence
  synthetic sequence
aaactggtaagagttatgataagac

SEQ ID NO: 1398 - DNA, 21 bp, Artificial Sequence
  synthetic sequence
ctggacggagctggtttatct

SEQ ID NO: 1399 - DNA, 21 bp, Artificial Sequence
  synthetic sequence
cccttttcttggcgtattgcc

SEQ ID NO: 1400 - DNA, 20 bp, Artificial Sequence
  synthetic sequence
gcctgggtctctgctatcaa

SEQ ID NO: 1401 - DNA, 20 bp, Artificial Sequence
  synthetic sequence
gccactttgtactccgcact

SEQ ID NO: 1402 - DNA, 19 bp, Artificial Sequence
  synthetic sequence
gagagtttgcctggacgga

SEQ ID NO: 1403 - DNA, 23 bp, Artificial Sequence
  synthetic sequence
cctctctatacaaatgccaacgc

SEQ ID NO: 1404 - DNA, 20 bp, Artificial Sequence
  synthetic sequence
tccaggcctcctctctttga

SEQ ID NO: 1405 - DNA, 21 bp, Artificial Sequence
  synthetic sequence
cccttttcttggcgtattgcc

SEQ ID NO: 1406 - DNA, 20 bp, Artificial Sequence
  synthetic sequence
ccgacaagggcgatttgaca

SEQ ID NO: 1407 - DNA, 20 bp, Artificial Sequence
  synthetic sequence
aagtcgcctccaataggtgc

SEQ ID NO: 1408 - DNA, 20 bp, Artificial Sequence
  synthetic sequence
actcattaccgctgcccaaa

SEQ ID NO: 1409 - DNA, 20 bp, Artificial Sequence
  synthetic sequence
tcttccaaagcagcctctcg

What is claimed is:

1. A method of treating Duchenne muscular dystrophy (DMD) in an individual having DMD, the method comprising:
   a) modifying a mutant dystrophin gene in the genome of a cell expressing the mutant dystrophin gene, said cell obtained from the individual, the method comprising introducing into the cell in vitro:
      i) a CRISPR/Cas9 endonuclease, or a nucleic acid comprising a nucleotide sequence encoding the CRISPR/Cas9 endonuclease; and
      ii) first and second CRISPR/Cas9 guide RNAs corresponding to the CRISPR/Cas9 endonuclease, or one or more nucleic acids comprising nucleotide sequences encoding the first and second CRISPR/Cas9 guide RNAs, wherein the first CRISPR/Cas9 guide RNA comprises a guide sequence that hybridizes to a target sequence within intron 44 of the mutant dystrophin gene, and the second CRISPR/Cas9 guide RNA comprises a guide sequence that hybridizes to a target sequence within intron 55 of the mutant dystrophin gene, wherein the target sequence within intron 44 and the target sequence within intron 55 are separated from each other by 700 kb to 725 kb as compared to a wildtype human dystrophin gene; wherein the modified mutant dystrophin gene encodes an in-frame transcript with flanking exon 44 joined with flanking exon 56 and has an intron therebetween of about 1 kb, wherein said intron comprises about 500 bp of the 5' end of intron 44 and the 3' end of intron 55; and
   wherein said introducing results in a deletion of 700 kb to 725 kb as compared to the wildtype human dystrophin gene,
   thereby producing a modified cell; and
   b) introducing the modified cell at or near a site to be treated in the individual.

* * * * *